United States Patent 7,447,594 (MOLECULAR CARDIOTOXICOLOGY MODELING) - sequence listing, part 2

SEQ ID NO: 1956 - DNA, 4198 bp, Rattus norvegicus
  Genbank Accession No. NM_017154
agagctcagtgactccagcagccacgatgactgcggatgagttggtcttctttgtgaatggcaaaaaggtggtggagaaaaatgcggaccctgaaacaacacttctggtctacctgagaagaaagttggggctatgtgggaccaagcttggctgtggagaaggtggctgtggggcatgcaccgtgatgatctccaagtatgaccgtcttcagaacaagattgttcatttttctgtcaatgcctgcttggctcccatctgctccttgcaccatgttgctgtgaccaccgtggaaggcataggaaacacccagaagctgcatcctgtacaggagagaattgccagaagccatggttcccagtgtgggttctgcactcctggcattgtcatgagtatgtacacactgctccggaaccagcctgagcctactgttgaggagatcgagaatgccttccaaggaaacctctgtcgctgtacaggctacagacccatcctccagggattccggacctttgccaaggatggtgggtgctgtggagggagtggaaacaacccaaactgctgtatgaaccagacgaaagaccaaacggtttctctctcaccttctttattcaacccagaggatttcaaacctttagatcccacgcaagagcccatcttccccccagagttgctgaggctgaaagacactccccagaagaagctgcgttttgaaggggaacgtgtgacctggatccaggcttcaactatggaggagctgcttgacctgaaagctcagcaccctgatgccaagctggtggtgggaaacacagagataggcattgaaatgaaatttaagaatatgctatttcctctgatcgtctgcccagcctggatccctgaactgaattcagtggtgcatgggcctgagggaatctccttcggagcttcttgcccccttagcttggtggaaagtgtcctggcggaggagattgctaaacttccagagcaaaagacagaggtgttcagaggcgtgatggagcagctgcgctggtttgccggcaagcaggtcaagtccgtggcgtccatcggagggaacatcatcactgccagccccatctctgacctcaaccctgtgttcatggccagtggagccaagctgactctggtgtctagaggtaccaggagaactgttcggatggatcataccttcttccctggctacagaaagactctgctcagaccagaggagatattgctgtccatcgagatcccctatagcaaggagggagagtttttctcagccttcaagcaggcctccaggagggaagatgacattgccaaggtgactagtggcatgagagtcctgttcaaaccggggaccattgaagtgcaggaactgtccctttgcttcggagggatggccgacagaactatctcagccctcaagaccactccgaagcagctatcgaagtcctggaatgaggagctgctgcagagcgtgtgtgccggcttggcagaggagctgcagctggcccccgatgcccctggtggtatggtggaattccggcgcaccctcaccctcagcttcttcttcaagttctacctgacagtgctccagaagctgggcagagcggaccttgaggatatgtgtggtaaactggaccccacctttgccagtgccaccctgctctttcagaaggaccctccagctaatgtccagcttttccaagaggtgccaaaggatcagtctgaggaggacatggtgggccggcccctgcctcacctggcggcaaacatgcaggcatcgggagaggccgtgtactgtgatgacattccccgctatgagaatgagctctctctcaggctggtcaccagcacccgggcgcatgctaaaatcacgtccatcgacacttcagaagccaagaaggtgccagggtttgtttgcttcctcaccgcagaggatgtccctaatagtaatgcaaccggccttttcaatgatgaaactgtctttgcgaaggatgaggttacttgtgttgggcacatcattggtgctgtggtcgctgacaccccagaacacgcacagagagctgcgagaggggtgaaaatcacctatgaagatcttccagccattatcacaatccaggatgctataaacaacaactccttttatggctctgagataaaaattgagaaaggagatctcaagaaaggcttttcagaagctgacaatgttgtctcaggagagttgtatatcggtggccaggagcacttctacctggagaccaactgcaccattgccgtgccaaaaggcgaggcaggcgagatggagctgttcgtgagcacacagaacaccatgaaaacccagagctttgttgcaaaaatgttgggcgttccggacaacagaatcgtagtccgagtgaagaggatgggtggaggctttggagggaaggagacccggagcactgtggtgtccacagcactggccttggctgcacacaagactggccggcccgtacgttgcatgttggaccgagatgaggacatgctgataactggtggcagacatcccttcctggctaaatacaaggttggcttcatgaagactgggactgtagtggctctcgaggtggctcacttcagcaatggtggtaacactgaggatctctctcggagtataatggaacgagctttgttccacatggataacgcctataagatccccaacattcgaggcactgggaggatttgcaagactaatctgccctccaacacagccttcagaggttttgggggtcctcaggggatgctaatcgcagaatactggatgagcgaggtcgccataacctgtgggctgcctgcagaggaggtacggaggaaaaacatgtacaaagaaggggacctgactcacttcaaccagaagctggaggggttcaccttgcccaggtgctgggatgaatgcatcgccagctctcagtatcttgctcgcaagagggaagtggagaaattcaacagggagaattgttggaaaaagagagggctgtgtataatcccaactaagtttggaataagctttacacttccttttctgaaccagggaggcgctctggttcacgtgtacactgatggttcggtgctgttgacccatggagggactgagatgggccaaggccttcacaccaagatggttcaggtggccagcagagctctgaaaatccccacctccaagattcatataagtgagacaagcactaacaccgtccccaacacttctcccacagctgcctctgccagtgctgacctcaatggacagggtgtttatgaagcatgccagaccatactgaaaaggctggaacctttcaagaagaagaaacccaccggcccctgggaggcatgggtgatggacgcctatacgagcgcagtgagtttgtccgcaactggattttataagacacccaaccttggctacagctttgagacaaactccggaaatcccttccactatttcagttatggggtggcttgctctgaagtagaaattgactgcttaacaggggatcataagaatctccgtacggatatcgtcatggatgttggttccagcttgaatcctgccattgatattggacaagtagagggggcatttgtccagggccttggtctcttcactatggaggagctgcactactcccctgaggggagcctgcatactcgtggccccagtacctacaaaatccctgcatttggtagcatccccattgagttcagagtatccctactccgggactgccccaacaagagggccatctatgcatccaaggctgttggggagccacctcttttcctggcttcctctatcttctttgccatcaaagatgccattcgtgcagctcgagctcagcacggagataacgcaaaacaacttttccagctagacagccctgccactccggagaagatccgaaacgcctgtgtggaccagttcaccaccctgtgtgtcactggagtaccagaaaactgtaaatcctggtctgtgaggatctgaagagaaggtctccaccattggtttgtaccgcaccaggattccttggagccacaagcacatcctgtagtatccagatttccgcatgccgcgtgggactcagcaggatgacattttcaggaagatggacattttgacccaaataagagctgcaaacaaaccaataagcaaatggggag

SEQ ID NO: 1957 - DNA, 801 bp, Rattus norvegicus
  Genbank Accession No. NM_017160
gtcggctgtgtcaagatgaagctgaatatctccttccctgccactggctgtcagaaactcatagaagtggatgacgaacgcaagcttcgtacgttctatgagaagcgcatggccacagaagtagctgctgatgctcttggtgaagagtggaagggttatgtggtccggatcagcggtgggaatgacaaacaaggttttcccatgaagcaaggcgttttgacccatggcagagtgcgcctgcttttgagtaaggggcattcttgttatagacctaggagaactggagagaggaagcgcaagtctgtccgaggatgcattgtggatgccaacctgagtgttctcaacttggttattgtaaaaaaaggagagaaggatattccaggactgacagataccactgtgcctcgtcggttgggacctaaaagagctagtagaatccgaaagctttttaatctctccaaagaagatgatgtccgccagtatgttgttagaaagcccttaaacaaagaaggtaagaagcccaggaccaaagcgcccaagattcagcgtcttgttactccccgtgtcctgcaacacaaacgccgacgtattgctctgaagaagcaacgcactaagaaaaacaaggaggaggctgcagaatatgctaaacttttggccaagagaatgaaggaagccaaagagaagcgccaggaacagattgccaagagacgtaggctgtcttcgctgagagcttctacttctaaatctgagtccagtcaaaaataagtctttaaagagtaacaaataaataatgagaccttg

SEQ ID NO: 1958 - DNA, 872 bp, Rattus norvegicus
  Genbank Accession No. NM_017165
gactcggcctcgcgcgtccattggtcggctgcgtgaggggaggagccgctgcccgccgagatgagctggggccgtctgagccgcttattgaagccagcactgctgtgcggggctctggctgtgcctggcctggctggcaccatgtgtgcatcccgcgatgattggcgctgtgcgcgctccatgcacgaattctcagccaaggacatcgatgggcacatggtttgcctggataagtacaggggttgcgtgtgcatcgtcaccaacgtggcctcgcaatgaggcaaaaccgacgtaaactacactcagctagtcgatctgcatgcccgatacgccgagtgtggtttacgaatcctggccttcccttgcaaccagttcgggaggcaggagccaggaagtaatcaagaaatcaaggagtttgcagccggctacaatgtcaggtttgacatgtacagcaagatctgtgtaaatggggacgatgcccacccactgtggaaatggatgaaagtccagcccaagggcaggggcatgctgggaaatgccatcaaatggaactttaccaagtttctcattgataagaacggctgcgtggtgaagcgctatggtcccatggaggagccccaggtgatagagaaggacctgccgtgctatctctagccctacaagtgttggcccctgcaccgagcccccctgccctgtgacccctggagccttccaccccggcactcatgacggtctgcctgaaaaccagcccgctggtggggcagtcccgaggacctggcgtgcatccccgccggaggaaggtccagacgctgtggccccgggctcgaggcttcaccttggctgccttgtgggaataaaatgtagaaatgtgc

SEQ ID NO: 1959 - DNA, 1054 bp, Rattus norvegicus
  Genbank Accession No. NM_017166
ggtccgagccgcctggcttaggcggaggcgacggcagggtagggagcagccgggaacgcggcgagcccctagccggggacacgggacgggcggagacctcgagccctgggctttccttgccagtggattgtgtagagtgtacagccagtctcttgtcttctgtccaacatggcatcttctgatattcaggtgaaagagctggagaagcgagcttccggccaggcttttgagctgattctcagccctcgatcaaaagaatctgtccccgagttccccctttcccccccaaagaagaaggatctttccctggaggaaattcagaagaaattagaagctgcagaagaaagacgcaagtctcatgaagcagaagtcttgaagcagctcgctgagaagcgggagcatgaaaaagaagtgctccagaaagccattgaggagaacaacaacttcagcaaaatggcagaggagaaactgacccacaaaatggaggctaacaaagagaaccgggaggcgcaaatggctgccaagctggagcgtttgcgagagaaggacaagcacgttgaagaggtgcggaagaacaaagaatccaaagaccccgcggacgagaccgaggctgactaagttgttccgagaactgactttctccccgaccccttcctaaatatccaaagactgtactggccagtgtcatttactttttcctccctgacaaatattctagaagctgatgtaggaaccgtataggtagatccagaccgtgagatgttttaggggctcaaggggagaaactgaaagtgttttgctcttttttaaagtgttggtctttctaacgtagctatttttctcgttgcatcttttcctctcgggcacactcggtgtgctgggttaatggctagtgctgtattgactgtggaagacgttcgtgaagagtatgtagtggcttcttccaacccattagatgctgagtatctgttcactttgcgatcccaattctgtcccaatctcaccagatgctactgtactggaatggttaataaactgcacagtgctgttggtc

SEQ ID NO: 1960 - DNA, 2741 bp, Rattus norvegicus
  Genbank Accession No. NM_017172
ccgggagcaggcgtgtgggactcctgaccggagagccggaggctgcgccttccccgcaccgggaccttcacgacacaacagatcctagtccttgccccgtgcgaacgcccacgatgaccaccaccctcgtgtccgccaccattttcgacttgagcgaagttttatgcaagggtaacaagatgctcaactacagcactcccagtgctgggggctgcctgctggacaggaaggcagtgggcacccctgctggcgggggcttccctcggaggcactcggtcactctgcccagctccaagttccatcagaaccagcttctcagcagtcttaagggtgagccggccccgaccctgagctcacgcgacagccgctttcgagaccgctctttctccgaagggggcgagcggctgctgcccactcagaagcagcctgggagcggccaggtcaactccagccgctacaaaacggagctgtgccgccccttcgaagaaaacggtgcctgtaagtacggggacaagtgccagttcgcgcacggcatccacgagctccgcagcctgacccgccaccccaagtacaagacggagctgtgccgcaccttccacaccatcggcttttgcccttatgggccccgctgccacttcattcacaacgccgaggagcgacgcgccctggcggggggccgggacctctccgctgaccgtccccgcctccagcatagctttagctttgctgggtttcccagtgccgctgccaccgccgctgccacggggctgctggacagccccacgtccatcaccccaccccccatcctgagcgccgatgacctcttgggctcacctaccctgcccgatggcaccaataaccccttcgccttttccagccaggagctggcgagcctctttgctcctagcatggggctgcccgggggaggctcccccaccaccttcctcttccggcctatgtccgaatcccctcacatgtttgactctccccccagccctcaggattctctctcggaccatgagggctacctgagcagctccagcagcagccacagtggctcagactcccctaccttggacaactcaagacgcctgcccattttcagcagactctccatctcagatgactaagccagggtagggagggaccccctgcctccttcacctctccaccctgcaccccatcccataccttcacctccccaccccctaactttccttcaaaccctacattcatacatttaagctcaacccctttcccagaaccttggtatgttacccttcccccaacataaggacaagtcaatttgttggtagcttctggcttgaaaaccccctccctccatttcatagcccacttaaccacgcataacagagtcccatctttgtcagtagatgccttttttttcggcttaagccttaagtgccaaatcacaaaagaaaaaaagcagtaaccgtttacagaagcaacttagtgccttgtaatctaactttggtcactgtgactacattacctcttcaacgccagggggcacccgtgggcctcccagagcctctgcccgtggggtttgggggcgggggagcggtgacccgcaaccagcagctccctcagctggccacacaagtgcaccttcctttcagtctcccgcacattcttcctcttccttgtagatacttgcctccctcagagaattgttgctggacttggggggggcgggggtttgggtgggtggggacctattttgacattcaaaaccttttttttcccagctcgaacccctgttgactaatcttgcctgggtttgtgtaggtctccagggacaaaggttgaacaagttggacgaaggttttgacataagtgggactttgtgatttaatttcttttttttctttttctttcttttttttttaagtggggaggaaggggaaactagatggactatgagagacttgattttggtgctaaagttccccaattcatatgtgtacatcttaaaaatgacaacaaatgagagaaaagctaaaaaaaaaaaaaaaaaaaaaagaagaaaacctatgtaaggggtgagcagtaatggtattcattccacatacaatatctgtgtaaaaacaatttcctgtagacgtagctttaatggattttgctctagaataccttaggtctaccttagagccctcacgccatgcttttgtccctgggtttaaacttcatctaactttcagaaattggagagcaaaaatgttgctttatcactgcacatcaatataaaaaagcttatttaacttatcaagacgtatttattgccaaactatgctttttttttgttaattttgttcatatttatcgggatgacaaatccatagaatatattcttttatgttaaattatgatcttcatattaatcttaaaattttgtgacgtgtctttccttttttttttccacagttttaatatattattcttcaacaacatttttgtaactttacacttttttttggttattttattttaaaaaaatgaaaaattaatttaaaaaaaatgcaaaaaactgttggattatttattttagaaattctcccctttgtgttggactgcaaattgagtttctttctccttaggcctttcacaggtaggactgagaatgtataagttctgtgacagtacagaaggaaaaccaccatttatgtatagcttctaaaagggaaaacaaaaaaaaaaagagagagagagaaaaacccttt

SEQ ID NO: 1961 - DNA, 2063 bp, Rattus norvegicus
  Genbank Accession No. NM_017173
agcggacgctgtctgaggagtagagcctgcctgagagcgagtgtcccgtcggtcccggagcagcccagcccggcccagccctcacaggtcctctgtggtgcacacagcccacctcccagccatgcgctctctccttctgggcaccttatgcctcctggctgtggccctggcagccgaggtgaagaaacctgtagaggccgcagcccctggtactgcggagaagctgagttccaaggcgaccacactggcagagcgcagcacaggcctggccttcagcctgtatcaggcaatggccaaagatcaggcggtggagaatatcctcctgtcacccttggtggtggcctcatccctgggccttgtgtcactgggtggtaaagccaccacagcttcgcaggcgaaggcagtgttgagcgctgagaagctgcgggatgaggaggtgcacacggggctgggcgagctcgtgcgctccctcagtaactccactgcgcgcaatgtgacctggaaactgggcagccgcctgtacgggcccagctccgtgagcttcgccgatgacttcgtgcgcagcagtaagcaacactacaactgtgaacactccaagatcaacttccgagacaagcgcagcgcgctgcagtccatcaacgagtgggcctcgcagaccaccgacggcaagctgccagaggtcaccaaggatgtggagcgcacggatggggcactgctcgttaatgccatgttctttaagccgcactgggatgagaagttccaccataagatggtagacaaccgtggcttcatggtgacccgctcctacactgtgggtgttacgatgatgcaccggacaggcctctacaactactatgacgacgagaaggagaagctgcagctggtggagatgcccttggcccataagctctccagcctcatcatcctcatgccccaccacgtagaaccgctcgagcgcctggagaagttgctgaccaaggagcaactaaagacctggatggggaagatgcagaagaaggctgttgccatctccctgcccaagggagtggtggaggtgacccatgacctgcagaaacatctggccggactgggcctgactgaggccatcgacaagaacaaggcagacttatcgcgcatgtctggcaagaaggatctgtacctggccagtgtgttccacgccactgccttcgagtgggacacagagggcaacccctttgaccaggacatctacgggcgtgaggagctgcgcagccccaagctgttctatgccgaccaccccttcatcttcctggtgcgagataatcagagcggctccttgctgttcattggccgcctggtccggcccaagggagacaagatgcgagacgagttgtagagtccaagagtggtcgtggcgtggcatggcgggaagtagccagaggttcctgagacacatgggtgctattgtggggggagggggaggcaccaaccctggatagtccacgggtgggggggggttggcagtgcagatcggaattcccataggtctgagtaggtatttttagacaagagtccactccgttagacatggagcccagacactatgagaccaaattcaggggtgtcacagccattctagccctgccccacaagttttatatccaatctagcctcaacagtcaatcagtgttcatattcgtggccaagcattctgtctgtgagacaatcgagttgggtgggggtagggcggcctagcctctctgtcaccatgccctgagccctcggttttcctgttcacctctgattccctttaaccacaaaactaggagcctgtggtcccagaactgcccacccttaaaatcgattctttgccgcagcagtgggagttggggagaccatgcataggagggctccttggcatatccggccctagagccattacattacattgacaactcaactttgcttctgttttctccctttttgagtttttcaaggaatgggggtttggggaaggggaagcctttattgctttcaaaacaagaacagtttgtcaattttttttgaataaaccttttccaatg

SEQ ID NO: 1962 - DNA, 1803 bp, Rattus norvegicus
  Genbank Accession No. NM_017174
gggggctgagcaggatgttgactggctatcgttcattgagcactctcacgatcagcatcacgcacggaatccatccttcctgtgttgcagcttgtagaccctgatgcttgggctgccagcataaacgtggggatccagactctgtctaccgaggctgcccatagggacaggccctgggaagaggagctgagaccaggctaaaaagaacccaagaaatgaagcgcctcctcacgctggcttggttcctggcttgcagtgtgcctgcagtcccagggggcttgctagaactgaagtccatgattgagaaggtgactgggaagaatgccgtaaagaactatggcttctacggctgctactgtggctggggcggccacgggacccctaaggatggcactgattggtgctgtcggatgcacgaccgttgttatgggctactggaggagaaacactgtgccatccggacccagtcctatgactacagattcacacaggacttagtcatctgcgaacacgactccttctgtccagtgaggctttgtgcttgtgaccggaagctggtctactgcctgaggagaaacctctggagttacaaccgtctttaccagtattaccccaacttcctctgctaatgtcctctgtgggctctcgccgggagtgcctcccacagtggcggcccccctcggctgtattcctgatccgtccacccaaggtcttggatctgccttcctctgtgtaccactgggctggacagagcccagggttacaccctaccctccagaatcctagagagggactctgatgtagagtctgcggactctggatagctgagcctgcacttgcagaatttggcgctgggccccggagctccctcagctccaggccagtgtcgtgttgactttcctttcaatttctggaacccaactgccattaccaccctccagagacctcttactagaggagaagccaaattaactctataaatctgccatgtagctattaaataaaacccattcacgaggcgagaagaacaccaccccagcactccctctgacagggctggggtaggagtgccaatgcttctctaacccctgaggcatctgtgcaccctctaggatggaggtcaggaaacaggtgggggccttacatgcctttcatggtttgtcttgagtttattttcttaaaccttagggtctttcaagccagacctggagctcaagattcttctggaggaaggtgagacacagccctatgccaccttgacgctccaggctagaaagggacagcccctagccctggcttctgcaactgtgtggtcttgaacctccgtatagtccgaatccctctggctctcctcaaaatataaaacaagcctccttccaatagcatattggtgcacacccctaatcccatcacctgggaggaggaggcggcaggagcatcaggagttcaaggccagctcctgccccctagcagggatggtaggctgcatgagagtgtgtctcagaaagaaccacctggtgcgggtacagggatgctgggattctgagatgtcactcagtgcgggaaaagattcaaggaggggaacagatcaatggcagaatgactgtctgtgccgagttaagggcactgaaaatctcagctcatctatcgctttatagaagatagagctttgggaggaagcaaggcactctacagtaaaggagtggcctttccaaggaagggtctaggctccttcttctccagaacatgcacaggacataggagatccattatttagagacctttcgtgttcgaacgttttct

SEQ ID NO: 1963 - DNA, 1353 bp, Rattus norvegicus
  Genbank Accession No. NM_017180
gagcgcctctcggagctgggttttcccccgcggcgcgggagccaggagccgccttttccgctgggtgtcactcgggggtggggagggtggcccattgaaaagcgctgcgaggggccccggccagtgcccttcagtgagcgctccgcggaagacggcagagagcagcccgctcacggctccgggatcttgtggcgggtcaggactcgcctgtccctctgccgggaccccgagccaccgccgccaccgccaccgctctgtctcctgcgagtcagccttctctgtgcgctccgggcaggcggccgcggaagccgctggagcgaggacagcgcacggctgctactgctacccccagccggagcgtctggaagcctaaaggccgagcggagcagcagcaccccttatgccggaaggatgctggagagcagcggttgcaaggcgctgaaggaaggagtgctggaaaagcgaagcgacgggctgctgcagctctggaagaaaaagtgctgcatcctcactgaggaagggctactgctcataccgcccaagcaggtacaacatcagcagcagcaacagcagcagcaacagcccgggcaggggacagccgaaccgtcccaacctagtggccccgccgtcaccagccttgagccaccagccaagctgaaggaattgcacttttccaatatgaagactgtagactgcgtggagcgcaagggcaagtatatgtacttcactgtggtgatggcggagggcaaagagatcgactttcggtgtccccaggaccagggctggaacgcagagatcacgttgcagatggtgcagtacaaaaatcgtcaggccatactggcggtcaagtctacgaggcagaagcagcagcacctggtccagcagcagcctccgcagacgcagcagatccaaccccagccccagcagccgcagatccaaccccagccccagccgcagatccagcctcaaccccaaccccaaccccaacctcagccccaaccccagcagcagccccagccccaacagctccactcctacccgcacccgcatcctcatctttaccctcaccctcaccctcacgcgcactcgcacccgcacccgcaccctcaccctcatccacaccaactccagcatgcgcaccagcctctccactcgcagccacagggccaccggcttctccgcagcacctccaactctgcctgaagagggcggcacccgggccactcaaggttttgaggacttcgggaagtgggaagagtgcattactatttaagttcacttggatcaaaaccaacggaggtctccccgccctgtgccagatcaagtagtttggacatcaccctacggataacg

SEQ ID NO: 1964 - DNA, 1570 bp, Rattus norvegicus
  Genbank Accession No. NM_017182
gcgggaagcgaggaggcgtgggcgggcaggcaggagtgcggagcggaccggcgcaagaggccgaccgggctcgggcccctcaccgtgcagccgcccgtgagcttgctgatctgtttctggggccgtcgccatgtcgagccgtggtgggaagaagaaatccaccaagacctcccggtcagccaaggccggggtcatcttccccgtgggacggatgctgcggtacatcaagaaaggccaccctaagtatcggatcggagtgggggcgcctgtgtacatggctgccgtactggaatacctgaccgctgagatcctggagctggccggcaatgcagcgagagacaacaagaaggggcgggtcacgccgcggcacatcctgttagcagtggccaatgatgaggagctaaaccagctgctaaaaggagtcaccatagccagtgggggcgtgttgccgaacatccatcctgagttgctagcgaagaaacgaggatccaagggaaaattggaagccatcatcacgcctccaccagccaaaaaggccaagtctccatcccagaagaagccagtggctaagaaaacaggaggcaagaaaggggcccggaagtctaagaagcagggagaagtcagcaaggcagccagcgcagacagtacaacggagggcgcgcctacagacggctttactgtcctctctaccaagagcctcttcctcggccagaagctgaaccttattcacagtgaaatcagtaatttagccggctttgaggtggaggccataatcaatcctaccaatgctgacattgaccttaaagatgacctaggaagcacactggagaagaaaggtggcaaggagtttgtagaagctgttctggaacttcggaaaaagaacgggcccttggaagtagctggagctgctgttagtgcaggccacggcctgcctgccaagtttgtcatccactgtaacagtcctgtctggggcgcagacaaatgtgaagaacttctagaaaagacggtgaaaaactgcctggctctagctgatgacagaaagctgaagtccatcgccttcccgtctattggcagtggcaggaacgggttcccgaagcagacagccgcccaactcattctgaaggccatctccagctactttgtgtccactatgtcgtcctccatcaaaactgtgtactttgtgctttttgacagtgagagcataggcatctacgtgcaggaaatggccaaactggatgccaactaggccagcgttccctagagccagcacatgtcgtggcccccacctccaactggaaagaaagaaaaaaaaagaaaaaaatcccctcggctcttatggggaggtgggggctcctttccttttcagttctgctcatctaggggaaataaggttttggtttccggtttgattgtttttggccttctacaatgttttctgttagcactgatagctggcattgtccttgctaagcactgcgttccagaccgtgtctgacttagttaacctaggagattttatagttttactttaatgaagtcctgattaacacagagcagtggagagaccgtg

SEQ ID NO: 1965 - DNA, 1264 bp, Rattus norvegicus
  Genbank Accession No. NM_017188
ggcagcgggcgaggatctgcggccccgcgaggccatgaaggtgaagaagggcggcggcgggaccggaccgggggcggagcccgttcctggggcctcgaaccggagcgtggagcccacgcgggagcctggggcggaagccgagtccgggtccgagtcggagccggagccaggcccggggcccagactggggccgctgcagggcaagcagcccatcgggccggaggacgtgctggggctgcagcggatcaccggcgactacctgtgctcccctgaggaaaatatctacaagattgacttcgtcaggttcaagatccgggacatggactcagggactgttctttttgaaatcaagaagccccctgtttccgaacggttgcccatcaaccggcgggacctggaccccaatgcagggcgctttgttcgataccagttcacacctgccttcctccgcctaaggcaggtgggagccacggtggagttcacagtgggagacaagccggtcaacaacttccgcatgattgagaggcactactttcgaaaccagctcctcaaaagcttcgacttccactttggcttctgcattcccagcagcaagaacacctgtgagcacatctatgacttcccgcctctctccgaggagctaatcagtgagatgattcgtcatccgtatgagacacagtctgacagcttctacttcgtggatgatcggctggtgatgcacaacaaggcagactattcctacagcgggaccccctgacctccaacactgcccctgaggctctggcctggaccctgtgctgtgacctctccaacactgtctctatttggggatggttccagtggctctggaccctgagtcagtcttgagaggaaggttccccagcatccctaggcaagcctctgaagcttgtgggagggacagctcgggagactgtccccatgttcaggaaggcctcctgcaagaggaggacttccggatgcctcactaggtccactgggcctgagtttcagagtagtgttcccttcttgactgtgactagatcaggttagggatccgttccctgtcccttgcccaccacctccagggtgtttatagttcacagacaaagatccacattgggtaccctggtctcagtcctggcctcctccatcaggggccaagaaactgcccgaggtgtgagcggggtgggtccagattgcaacctgtaggacctggacaaactgtatatagttttcaataaaccttttctgttaaaaaaaaaaa

SEQ ID NO: 1966 - DNA, 757 bp, Rattus norvegicus
  Genbank Accession No. NM_017199
ggaaacggacacgtcagtgccgccagcgacgtcaccatgcccgacccagcccgccgacgcacgattgggtgctgaggccgcttacgcgtcgcgcttcctcgtctgctccgcatgttcagggcggcttgctctcttttcccctcggcagagaagaggcgatggcggcgatggcatctttcggcgccctggcgctactcctgctgtccggcctatcttgctgctcagcagaggcctgcctggaaccccagatcaccccttcttactatacaacttcagatgccgtcatttctacagagactgtattcatcgtggagatctcactgacctgcaaaaacagggtccagaatatggctctttatgccgacgttagtggaaaacaatttcctgtaacccgcggccaggatgtgggtcgatatcaggtgtcctggagcctggagcacaagagcgcccatgcaggcacctatgaggtcagattcttcgatgaagagtcctacagcctcctaaggaaggctcaaagaaataatgaagacgtttccatcatcccaccactgttcacagtcagtgtggaccatcggggtacctggaatgggccttgggtctccacggaggtgctggctgcagcaattggcatagtgatctactacctagctttcagtgcaaagagccacatccaggcctgagggcagcaacctcagccctccattgcttctttcaataaacagtcactatttgaaaaaaaaaaaaaaaaaaaaaaaaa

SEQ ID NO: 1967 - DNA, 2029 bp, Rattus norvegicus
  Genbank Accession No. NM_017201
ctcactctagcggacttcgccagcatggctgataaactgccctacaaagtcgcggacattggactggctgcctggggacggaaggccctggacatagctgagaacgagatgccaggtttgatgcgcatgcgggagatgtactcagcctccaagccactgaagggcgctcgcattgctggctgcctgcacatgactgtggagactgctgtcctcattgagactctcgtggccctgggtgctgaggtgcggtggtccagctgcaacatcttctccactcaggaccatgcagcggctgccattgccaaggctggcattccagtgtttgcctggaagggagagacggatgaagagtacctgtggtgcattgagcagacgttgcacttcaaggacggacccctcaacatgattctggatgatggcggtgaccttactaacctcatccacaccaaacacccacagcttctgtcaggcatccgaggtatctctgaggagaccacgactggcgtccacaacctctacaagatgatggccaatgggatactgaaggtgcctgccatcaacgtcaacgattctgtcaccaagagcaagtttgacaacctctatggctgccgggagtccctcatagatggcatcaaacgggcaacagatgtgatgattgcgggcaaggtggcagtggtagcaggctatggtgatgtgggcaagggttgtgcccaggccctgcggggtttcggggcccgagtcatcatcaccgagattgaccccatcaatgcactgcaagctgccatggagggctacgaggtaaccaccatggacgaggcctgtaaggagggcaacatctttgtgaccaccacgggctgtgttgatatcatccttggtcggcactttgaacagatgaaggatgatgccattgtctgtaacattggacacttcgacgtggagattgatgtgaagtggctcaatgagaacgctgtggagaaggtgaacatcaagccccaggtggaccgctacttgctaaagaatgggcaccgcatcatcttgctggctgagggccgtctggtcaacctgggttgtgccatgggccaccccagcttcgtgatgagcaactccttcacaaaccaggtgatggcacagattgagctgtggacccacccagacaaataccccgtgggggttcacttcctgcctaagaagctggatgaggcagtggctgaagcccacctgggcaagctgaacgtcaagctgaccaagctgactgagaagcaggctcagtacctgggcatgcccattaacggccccttcaagcctgatcactaccgctactgagagctgggactgcccttcaccttccagctgccatccttgttccaggccctacctctcgttcccaagagcaaatgtcaccaactttgcagttacttctccggtgttctgctccctcccccggccctcatccacactgtgactggtctttctgtctttggcttctgctgtacccctcatactgttccctatgtggcatagagaacagagaggtacctgggaggcatccacaggggatctgagctcttggaaggtctgaggctggatgttgctggtggtcacaagcccatgcaccttactatccaaactctcgcttggtctttagatccgtgtgcttggtttacagaccaatggtttctcggcccaggacccaagaaggagctctaccatgggggaaggaaccactggagtttgaaggctcctgagagcttggcctttttactgttgggctgtctcttaaacctcctaatactgagttggctacttttggtccctatttcacaagggttaggacagattaaccaagaaaggacaagtgacagagactgaaaggggctggaaaaacaaatagggaaaggcctgtcacctacggtataattgatggttcctatcacaagcctggatcacaaacagattaatttgttctatgtttatatactgtttagaatgttaacacaggaaggtggataaaatacagtttctagtgcct

SEQ ID NO: 1968 - DNA, 696 bp, Rattus norvegicus
  Genbank Accession No. NM_017202
gctcttccggtgcgggacccgctcttccggtcgcgagcacccggggtgtagagggcggtcgcggcggtcgcctgggcagcagtggcagaatgttggctaccagggcacttagcctaattggcaagagagccatttctacttcggtgtgccttcgggcacatgggagtgttgtgaagagtgaagactatgctctcccatcttatgttgatcggcgtgactaccccttgcctgatgtggcccacgtcaagctgctgtctgccagccagaaggccctgaaggagaaggagaaggccgactggagcagcctttccagggatgagaaagtccaattgtaccgcatccagtttaacgagagcttcgctgagatgaacaagggcaccaatgagtggaagacagtggtgggcctggccatgttcttcatcggcttcactgcgcttgtgctgatctgggagaagagctacgtgtatggccccatccctcatacctttgatcgtgactgggtggccatgcagaccaagcggatgctggacatgaaggtcaaccccattcagggcttctccgccaagtgggactacaacaagaatgaatggaagaagtgagagcctgctgctgtgggctcctccctccctccctccctcagcatgctggaagctgctgtgtccaatggtccatgttaataaatgaccagtttacgtg

SEQ ID NO: 1969 - DNA, 2489 bp, Rattus norvegicus
  Genbank Accession No. NM_017206
gccaacgccgcgatcgccgccaatcccgccagcctcgggccgggccatccgctgtgggcttagccacccagatgcagagccagtgccacagcctcttcagaggagcctctcaagcaaaacgaggagatggccaccaaggagaagcttcaatgtctgaaagacttccacaaagacatcctgaagccttctccagggaagagcccaggcacgcggcctgaggatgaggctgatgggaagccccctcagagggagaagtggtccagcaagatcgactttgtgctgtctgtggccggaggcttcgtgggtttgggcaatgtctggcgtttcccgtacctctgctacaaaaatggtggaggtgcattcctcataccgtattttattttcctgtttgggagcggcctgcctgtgtttttcctggaggtcatcataggccagtacacctcagaagggggcatcacctgctgggagaagatctgccccttgttctctggcattggctacgcgtccatcgtcatcgtgtccctcctgaatgtgtactacatcgtcatcctggcctgggccacatactacctattccagtctttccagaaggatcttccctgggcccactgcaaccatagctggaacacgccacagtgcatggaggacaccctgcgtaggaacgagagtcactgggtctcccttagcgccgccaacttcacttcgcctgtgatcgagttctgggagcgcaacgtgctcagcctgtcctccggaatcgaccacccaggcagtctgaaatgggacctcgcgctctgcctcctcttagtctggctcgtctgttttttctgcatctggaagggtgttcggtccacaggcaaggttgtctacttcactgctactttcccgtttgccatgcttctggtgctgctggtccgtggactgaccctgccaggtgctggtgaaggcatcaaattctacctgtaccctaacatcagccgccttgaggacccacaggtgtggatcgacgctggaactcagatattcttttcctacgctatctgcctgggggccatgacctcactgggaagctataacaagtacaagtataactcgtacagggactgtatgctgctgggatgcctgaacagtggtaccagttttgtgtctggcttcgcaattttttccatcctgggcttcatggcacaagagcaaggggtggacattgctgatgtggctgagtcaggtcctggcttggccttcattgcctacccaaaagctgtgaccatgatgccgctgcccaccttttggtccattctgttttttattatgctcctcttgcttggactggacagccagtttgttgaagtcgaaggacagatcacatccttggttgatctttacccgtccttcctaaggaagggttatcgtcgggaaatcttcattgccatcgtgtgcagcatcagctacctgctggggctgacgatggtgacggagggtggcatgtatgtgtttcaactctttgactactatgcagctagtggtgtatgccttttgtgggtcgcattctttgaatgttttgttattgcctggatatatggcggtgataacttatatgacggtattgaggacatgatcggctatcggcctggaccctggatgaagtacagctgggctgtcatcactccagctctctgtgttggatgtttcatcttctctctcgtcaagtatgtacccctgacctacaacaaagtctaccggtaccctgattgggcaatcgggctgggctggggcctggccctttcctccatggtgtgtatccccttggtcattgtcatcctcctctgccggacggagggaccgctccgcgtgagaatcaaatacctgataacccccagggagcccaaccgctgggctgtggagcgtgaaggggctacgccctttcactccagagcaaccctcatgaacggtgcactcatgaaacccagtcacgtcattgtggagaccatgatgtgaggtccgggctgtgtgaccggcgccgctttcctgccgtttactaaccttagattctcctaggaccaggtttacagagctttatatttgtactaggattttttttttaattgtcacagaaaatgttactctgtgtgtgtgtgtgtgtgtgtgtgtgtgtgtgtgtgtgtgtgtgtttcgtgtgtgtctgtatatgtgtattttgttttatttgggggattattttgtacaaaaagaaaacccatgggcctatgtcctggggggagaggatggactttcatattgattttgatgtattttatgggaacttggtaaatttttctttgtatttttttaacatataactatatatagagtctgtcatacactttgccacttgaattggtcttgccagcaacggatctcgttttttgttttttgtttttttttcaaaagcaattcttcggtgcttacatagctggcagagagttctgcccaaaaacaaatgaaaaaaaaaaaaa

SEQ ID NO: 1970 - DNA, 5240 bp, Rattus norvegicus
  Genbank Accession No. NM_017212
cctcccctggggaggttcgcgttcccgtggctcgcgcctgctgcccgccggcctcgagaacgcgctctctcggccgcggcgctcacagtctccgccacccaccagctccagcaccagcagcagcgccggcgccaccgcccaccttctgctgtcgccgccgccacaaccaccttcccctccgctgtcctcttctgtcctcgcctcctgtcgattatcaggctttgaagcagcatggctgaaccccgccaggagtttgacacaatggaagaccaggccggagattacactatgctccaagaccaagaaggagacatggaccatggcttaaaagctgaagaagcaggcatcggagacaccccgaacatggaggaccaagctgctgggcatgtgactcaagctcgagtggccggcgtaagcaaagacaggacaggaaatgacgagaagaaagcgaagggggccgatggcaaaacgggggcgaagatcgccacacctcggggagcagccactccgggccagaaaggcacatccaatgccaccaggatcccagccaagaccacacccagcccaaagactcctccaggatcaggtgaaccaccaaaatccggagaacgaagcggctacagcagccccggctcgcccggaacccctggcagtcgctcccgtaccccatccctaccaacgccgcccacccgagagcccaaaaaggtggcagtggttcgcactccccctaagtcaccgtctgccagtaagagccgcctacagactgcccctgtgcccatgccagacctaaagaacgtcaggtccaagattggctccactgagaacctgaagcaccagccgggaggcggcaaggtgcagataattaataagaagctggatcttagcaacgtccagtccaagtgtggctcaaaggacaatatcaaacacgtcccgggcggaggcagtgtgcaaatagtctacaagccagtggacctgagcaaggtgacctccaagtgtggttccttagggaacatccatcacaagccaggaggtggccaggtagaagtaaaatcagagaagctggacttcaaggatagagtccagtcgaagattggctccttggataacatcacccatgtccctggaggagggaataagaagattgaaacccacaagctgaccttcagggagaatgccaaagccaagacagaccatggagcagaaatcgtgcacaagtcacctgtggtgtctggggacacatctccacggcacctcagcaacgtctcctccacgggcagcatcgacatggtggactctccacagcttgccacgttagccgatgaagtgtccgcctctttggccaagcagggtttgtgatcaggcccctggggccgtcactgatcatggagagaagagagagtgagagtgtggaaaaaaaaaaaaaaagaatgacctggcccctcaccctctgccctccccgctgctcctcatagacaggctgaccagcttgtcacctaacctgcttttgtggctcgggtttggctcgggacttcaaaatcagtgatgggaaaaagtaaatttcatctttccaaattgatttgtgggctagtaataaaatatttttaaggaaggaaaaaaaaaacacgtaaaaccatggccaaacaaaacccaacatttccttggcaattgttattgaccccgcccccccctctgagttttagagggtgaaggaggctttggatagaggctgcttctggggattggctgagggactagggcaactaattgcccacagccccatcttaggggcatcagggacagcggcagacatgaaagacttgggacttggtgtgtttgtggagccgtaaggcgtatgttaactttgtgtgggtttgagggaggactgtgatagtgaaggctgagagatgggtgggctgggagtcagaggagagaggtgaggaagacaggttgggagagggggcattgcgtccttgccaaggagcttgggaagcacaggtagccctggctgcagcagtcttagctagcacagatgcctgcctgagaaagcacagtggggtacagtgggtgtgtgtgccccttctgaagggcagcccatgggagaaggggtattgggcagaaggaaggtaggccccagaaggtggcaccttgtagattggttctctgaaggctgaccttgccatcccagggcactgctcccaccctccaggaggaggtctgagctgaggagcttccttttcgatctcacaggaaaacctgtgttactgagttctgaagtttggaactacagccatgattttggccaccatacagacctgggactttagggctaaccagttctttgtaaggacttgtgcctcttgcgggaacatctgcctgttctcaagcctggtcctctggcacttctgcagtggtgagggatgggggtggtattctgggatgtgggtcccaggcctcccatccctcgcacagccactgtatcccctctacctgtcctatcatgcccacgtctgccacgagagccagtcactgccgtccgtacatcacgtctcaccgtcctgagtgcccagcctcccaagcccaatccctggacccctgggtagttatggccaatctgctctacactaggggttggagtccagggaaggcaaagatttgggccttggtctctagtcctacgttgccagaatccaaccagtgtgcctcccacaaggaaccttacaaccttgtttggtttgctccatcaggcgtttggcgccatcgtggatggagtccgtgtgtgcctggagattaccctggacacctctgctttttttttttttactttagcggttgcctcctaggcctgactccttcccatgttgaactggaggcagccaagttaggtgtcaatgtcctggcatcagtatgaacagtcagtagtcccagggcagggccacacttctcccatcttctgcttccaccccagcttgtgattgctagcctcccagagctcagccgccattaagtccccatgcacgtaatcagcccttccataccccaatttggggaacataccccttgattgaaatgttttccctccagtcctatggaagcggtgctgcctgcctgctggagcagccagccatctcagagacgcagccctttctctcctgtccgcaccctgctgcgctgtagtcggattcgtctgtttgtctgggttcaccagagtgactatgatagtgaaaagaaaaagaaaaagaaaaaagaaaaaagaaaaaaaaaaaaggacgcatgttatcttgaaatatttgtcaaaaggttgtagcccaccgcagggattggagggcctgatattccttgtcttcttcgtgacttaggtccaggccggtcgagtgctaccctgctggacatcccatgttttgaagggtttcttcttcatctgggacccctgcagacactggattgtgacattggaggtctatacattggccaaggctgaagcacaggacccgttagaggcagcaggctccgactgtcagggagagcttgtggctggcctgtttctctgagtgaagatggtcctctctaatcacaacttcaagtcccacagcagccctggcagacatctaagaactcctgcatcacaagagaaaaggacactagtaccagcagggagagctgtggccctagaaattccatgactctccactactatccgtgggtcctttccaagccttgcctcgtcaccaagggcttgggatggactgccccactgatgaaagggacatctttggagacccccttggtttccaaggcgtcagccccctgaccttgcatgacctcctacagctgaaggatgaggcctttaaagattaggaacctcaggcccaggtcggccactttgggcttgggtacagttagggacgatgcggtagaaggaggtggccaacctttccatataagagttctgtgtgcccagagctaccctattgtgagctccccactgctgatggactttagctgtccttagaagtgaagagtccaacggaggaaaaggaagtgtggtttgatggtctgtggtcccttcatcatggttacctgttgtggttttctctgtatacccccatttacccatcctgcagttcctgtccttgaataggggtgggggtactctgccatatctcttgtaggcagtcagcccccaagtcatagtttggagtgatctggtcagtgctaataggcagtttacaaggaattctggcttgttacttcagtgaggacaatcccccaaggccctggcacctgtcctgtctttccatggctctccactgcagagccaatgtctttgggtgggctagatagggtgtacaatttgcctggaacctccaagctcttaatccactttatcaatagttccatttaaattgacttcaatataagagtgtatccatttgagattgcttgtgttgtggggtaaaggggggaggaggaacatgttaagataattgacatgggcaaggggaagtcttgaagtgtagcagttaaaccatcttgtagccccattcatgatgttgaccacttgctagagagaagaggtgccataaggctagaacctagaggcttggctgtccaccaacaggcaggcttttgcaaggcagaggcagccagctaggtccctgacttcccagccaggtgcagctctaagaactgctcttgcctgctgccttcttgtggtgtccagagcccacagccaatgcctcctcaaaaccctggcttccttccttctaatccactggcacatcagcatcacctccggattgacttcagatccacagcctacactactagcagtgggtaagaccacttcctttgtccttgtctgttctccagaaaagtgggcatggaggcggtgttaataactataggtctgtggctttatgagccttcaaacttctctctagcttctgaaagggttacttttgggcagtattgcagtctcaccctccgatggctgtagcctgtgcagttgctgtactgggcatgatctccagtgcttgcaagtcccatgatttctttggtgttttgagggtggggggagggacatgaatcatcttagcttagcttcctgtctgtgaatgtccatatagtgtactgtgttttaacaaacgatttacactgactgttgctgtacaagtgaatttggaaataaagttattactctgattaaacaaaaaaaaaaaaaaaaaaaaaaaaaaaaaaaa

SEQ ID NO: 1971 - DNA, 1176 bp, Rattus norvegicus
  Genbank Accession No. NM_017220
cggtcccggaagccggaacccgtagcttgtgggtctttggtctgaagaccatgaacgcggcggttggccttcggcgccgcgcgcgattgtcgcgcctcgtgtccttcagcgcgagccaccggctgcacagcccatctctgagtgctgaggagaacttgaaagtgtttgggaaatgcaacaatccgaatggccatgggcacaactataaagttgtggtgacaattcatggagagatcgatccggttacaggaatggttatgaatttgactgacctcaaagaatacatggaggaggccattatgaagccccttgatcacaagaacctggatctggatgtgccatactttgcagatgttgtaagcacgacagaaaatgtagctgtctatatctgggagaacctgcagagacttcttccagtgggagctctctataaagtaaaagtgtatgaaactgacaacaacattgtggtctacaaaggagaatagatcttaggtttaatattgtagaaaagctaatttcttttcttactagaaaaagctctttgtccttttaaagtacacagcagtcatcacctacccgtgtctccatgttgtgttctggtgtgcctgagcgttaaagggattgtgaggtctgtatgtaaatgcattaagaagcaaattcgaagtgcatcctgagtgtattcttggtgagaaagcaggggagaactgaggattgaagcccgggcctcacacatgtgaaacatatactctgctccgacatgcatcccagtccgccaaggccgtttagaggatctttacctagagatagagattgttttatcttcagctggagagacagctcagtggttaggagcactgactgcttctccagaggtcctgagttcaaatccaccagacggtggtggctcacaaccatctgtaatgggatccgatgctctcttctggtgtgtaggtgtacatacagacaaagcattcctacatttaagaaaatacataaataagtttcaaaaattatttcatctggggctggggatttagctcagtggtagagcgcttacctaggaagcgcaaggccctgggttcggtccccagctccgaaaaaaagaaccaaaaaaaaaaaaattatttcatctgagcaaaatgttttgatgtggaattatgtaaaggtaaaataaac

SEQ ID NO: 1972 - DNA, 4269 bp, Rattus norvegicus
  Genbank Accession No. NM_017222
ttaaaagtttggcgtgttgaaagtaagcattactcagctggcaatagagacagaaccaggggactggtgcttctgtggacttggccatttgcacagcacaagcagtgatggataactcctccgtctgttccccaaatgcaactttctgcgaaggtgattcctgcctagtaactgaaagcaacttcaatgccattctcagcacagtgatgagcaccgtgctcaccattcttctagccatggtgatgttttctatggggtgcaatgtggaaatcaacaagttcctaggacacataaagcggccatggggcatcttcgtgggcttcctctgtcagtttggaatcatgcctctcacaggatttatcctgtctgtggcctctggcatccttcctgtgcaggctgtggtggtgctaattatgggttgctgccctggaggaactggctccaatatcctggcctattggatagatggtgacatggacctcagtgttagcatgaccacttgctccacactgcttgctcttggaatgatgcccctttgcctcttcatctataccaagatgtgggttgactcaggaacgattgtgatcccctacgatagcattggcatttctctggttgcgcttgttattcctgtttccattggaatgtttgtaaatcacaaatggccccaaaaagcgaagattatacttaaaattggatccatcgcaggtgcaattctcattgtgctcatagctgtggttggaggaatactgtaccaaagtgcctggatcattgaacccaaactatggattataggaacaatatttcctatagctggctacagccttggtttcttcctggctagactagctggtcaaccctggtacaggtgccgaacagttgccttggaaactggaatgcagaacactcaactgtgttccaccattgtacaactctcctttagccctgaggatctcaaccttgtgttcaccttcccactcatctatactgttttccagctcgtctttgcagcaataatattaggaatgtatgtcacatacaagaaatgtcatggaaaaaatgatgctgagtttctagagaaaacagacaatgatatggaccccatgccatcattccaggagacaaacaagggatttcaaccagatgagaaatagacactaaggaggcaaaagaagaaagcttctggaacaacattcattaaacgaaaactaaaattatttcttttggtggaataatcagcagaaaaacaaatttaaaagttaaattcaaatttaaattattgggtttttttgtataaagggactagtgatccattcttttgtgtgacaaaggggtgtgtgtgtgtgtgtgtgtgtgtgtgtgtgtgtgtgcgcgcgcgcgcacgtgcgcgcgcacgtgcatgtgtgtttacaggagtcatttttctgtatccatggtcagattggtcacaagatattccttgattccaaattcacagaagcttaagcctcttttataaaaaggcaaagtgtttgtattaatctcctatatacttcaaatcaatattatcttactaaaatatttaacatgatgtaaatgttgtgtaaatagttgtccactgtattgtttagaaaatgattgttttatgtttagtacagatatcatttttcaatattttggccatagttaaaatcatagatgtcaaacatctttgggaggccaaagacatgtacatagaatgtatagatagatagatagatagatagatagatagatagatagatagatagatagatagatgatagacagacagaagataggcagacagagagatagctgattatcattaatatattatcagaaaacatctatagacctaacttgatataggtcaaacttgaaactttgtcatatgtaagctgaattcagagttaaatactttggtatgtaaaaatatagcatattactactgtaaaatgattttttcttgagtgcttatgattgtaagaagattgatgtgaatgaattttaattatgaattttaaatttttgcaacatatttacttgtgattttggactatactctggcaaatgtctatatttatattttagaaaagtagcttcaaatgacattctagaagtagaaatgagagaaagcattactaattaattcaataacaaattagaattggattaacttatctttttttttatccattcgcatacctctaggatccattgatactcattttatctttccagaaatagggctaattcaatacagtttaaatttgacaataatttttggaactctggagaggtttattcaaatatgacctgtatgaagcaggtccaaatgggccaatatgatagctattcagctcataggaggtgccataccagccaccacgagcaggaagatgtcagaagttacaaaggaaaaaaggtatcagtctagaaaatgacaatggagagacaaataatacaatgacaaataatacaatggagagacaaagaagcataaagaaaaagaaaaagataaaagaaatattgccaaaacttaatatggcaaaactgatgtgtgacaggaagtagatacaggaagattcatatctgaaagtgagatttgaagaagatgagaagtctccaggcagcaaagcaggaaagtcacccctcagatgtcacagatatacctataaatatgcctgtatatatccataatgatagaaaacaaataagatttggtaaaaatcagcaagattttatgactgccatagggaaggaatttgtcaagtgctgggtcttgagacccaacttggtttacttttcttcattttggagcagatacatgtttttaactagcctttagtggttggtcttatggaaacttttgatacccccatattcttgtggattcctttaacttataatgttctgccttcaaagagtatattacatttgattgatcttactttagatcacgaagaaggcttctggttgtagacttaaaatgttgcaatatatttaattggagatattgtcactgtctgtacagcatgtttgttccgacagcatgagggtctgagcttgactatcaacactcatataaaaatgctaagtatgataatgtgcagccgtaatcccagtgctagaaaggagaagccaggaggattagatccagtctagccaatcagtgggctctatgttcagtgagagaccatgttggaaatactaaaatgaacagctataaagggagttgcttacaattgaccacatacacatcacacacacacacacacacacacacacacacacacacacacggagcatcttctatcactagacaaaagaagtaagttgaactcagaatgtttgctttttgtgtgtgtaagtctaatttatttttttcttaaattgaactgattatggaatgtgaaggttaatttcttttttttttacttttttttattaacttgagtgtttcttatttacatttcgagtgttattccctttcctggtttcggggccaacatccccctaatccctccacctccccttctttatgggtgttcccctccccatcctccccccattgccgccctccccacaacaatcacgttcactgggggttcagtcttagcaggaccaagggcttccccttccactggtgatcttactagaatattcattgctacctatgaggtcagagtccacggtcagtccatgtatagtccttaggtagtggcttagtccctggaagctctggttgcttggcattgttgttcataaggggtctcgagctctatcaagctcttcagaactcagaatgttttaaagcactgggcattgactgggatacaagagactggattttcttctcagtaatgtcaagaaagtacctccaaggatacgaaaggaaatctagctgttaaaataccttgtgcactttcctcatcaagaagaaaacagacagatacactaaagacaccctgtgaatttctatcaagttttcaacatacccaatgtgcctggatgccagcagctgattcagctgggttttcttccctaatgattaaagaatgtgagtgacatagatctttgttttcttaccaggtagggtggcttgtgtttatttttcccctaatactctagaaggaagaaaaatagttaagctttctaaaatgacaaatctctatttttaaatgatttgggaaaagctgattaactcatgtatattattgcctctgtttcatattaaatgaatatttatattttaaaggaaagaataaa

SEQ ID NO: 1973 - DNA, 2227 bp, Rattus norvegicus
  Genbank Accession No. NM_017224
gagctgtccagacccccgaagtgaagaaaagaggcgagggcaagggagggccagaaccgagggagagagaaaggaggggcagcccaccagcccgctgtcctgccacagaaccggctcagctccagctccaggagtcactcagctgcagaggcagtggcagccccactcctcaggcaaagggcagcagacagacagacagaggtcctaggactggaggtcctcagtcattgaccactcagcctggcccagccccatggccttcaatgacctcctgaaacaggtggggggcgtcggacgcttccagttgatccaggtcaccatggtggttgctcccctactgctgatggcttcccacaacaccttgcagaacttcactgccgctatcccccctcatcactgccgcccacctgccaatgccaatctcagcaaagatggaggtctggaggcctggctgcccctggacaagcaaggacaacccgaatcgtgcctccgctttacttccccccagtggggaccacccttttacaatggcacagaagccaatggcaccagagtcacagagccctgcattgatggctgggtctatgacaacagcaccttcccttcaaccatcgtgactgagtggaaccttgtgtgctctcatcgggctttccgccagctggcccagtccctgtacatggtgggagtgctgctgggagccatggtgtttggctacctggcggacaggctgggccgccggaaggtgctgatcttgaactacctgcagacagctgtgtcgggaacctgtgcagcctatgcacccaactatactgtctactgcgttttccggctcctctcgggcatgtctttggctagcattgcaatcaactgcatgacactaaatgtggaatggatgcctatccacacccgtgcctatgtgggcaccttgattggctatgtctacagcctgggccagttcctcctggctggcatcgcctatgctgtgccccactggcgccacctgcagcttgtggtctctgtgccttttttcattgccttcatctactcttggttcttcattgagtcagcccgctggtactcctcctcaggaaggctggacctcaccctccgagccctgcagagagtggcccggatcaatgggaaacaagaagaaggggctaagctaagtatagaggtgctccggaccagcctgcagaaggaactgactctaagcaaaggccaagcctcagccatggagctgctgcgctgccccacccttcgacacctcttcctctgtctctccatgctgtggtttgccactagctttgcctactacgggctggtcatggacctgcagggctttggggtcagcatgtaccttatccaggtgattttcggtgccgtggacctgcctgccaagtttgtatgcttcctagtcatcaactccatggggcgccggcctgcacagatggcctccctgctgctggcaggcatctgcatcctggtgaatggcataataccgaagagccatacgatcattcgcacctccctggctgtgctagggaagggctgcctggcttcctctttcaactgcatcttcctgtacaccggagagctgtaccccacagtgattcggcagacaggcctgggcatgggcagcaccatggcccgggtgggcagcattgtgagcccgctggtgagcatgactgcagagttctacccctccatgcctctcttcatcttcggcgctgtccctgtggtcgccagtgctgtcactgccctgctgccagagaccttgggccagccgctgccagatacagtgcaggacctgaagagcaggagcagaggaaagcagaatcaacagcagcaggaacagcagaagcagatgatgccgctccaggcctcaacacaagagaagaatggactttgagaacggaagggcttcacacagcactaaagggagtggggttctacaggtcctgccgtctacatgaggagggggagtgagtagagggactggaccatccaaatgtggaggctgccattcagagaaatccctccccaaaggtcatgtcagtagacccactaggaacaaaagctctgactatgtgcagcttcttaagcagaatgttctcgtcaccggccatcttcctgctcatggtcactccgccacctccaggaccttgcaaagaatctcagacaattaaatgaatctcttctaaaaaaaaaaaaaaaaaaaaaaaaaaaa

SEQ ID NO: 1974 - DNA, 4507 bp, Rattus norvegicus
  Genbank Accession No. NM_017226
cctgtagcaggtgctcattcccgggagcagcgcggactgcagccgcctctgcggggaaagatgctgcgggagcggaccgtacggctgcaatacgggagccgcgtggaggcggtgtacgtgctgggcacgcagctctggaccgatgtctacagtgcagcgcctgctggggccaaaaccttcagcctgaagcactcggagggtgtgaaagtagaggtcgtgcgcgatggagaggcagaggaggtagtcaccaacggcaagcagcgttgggccctgtcacccagcaccacactgcgactcagcatggcccaggccagcaccgaggccagcagcgacaaggtcaccgtcaactactatgaagaggatggcagtgcccctattgaccaggctgggctcttcctcactgccattgagatctcactggatgtggacgcagaccgggacggagaagtggagaagaataatcctaagaaggcatcctggacctggggtcctgagggccagggggccatcctgctggtgaactgtgaccgagacacaccctggttgcccaaggaggactgcagtgatgaaaaggtctacagcaaacaagaccttcaggacatgtctcagatgatcctgaggaccaaaggccctgaccgcctgcccgccgggtatgaaatagtcctctacatttctatgtcggactcggacaaagtgggcgtgttctacgtggagaacccgttctttggccagcgctacatccacatcctgggccggcagaagctctaccacgtggtgaagtacaccggtggctctgcagagttgctgttcttcgtggaaggcctccgtttcccagacgagagtttctcaggcctggtttccatccacgtcagtctgctggagtatatggccgaggacatcccattgacacccatcttcacagacaccgtgacgttccggattgccccatggattatgacacccaacatcctgcctcccgtgtcagtgtttgtgtgctgcatgaaggacaattacctgttcctgaaagaggtgaagaacctggtggagaaaaccaactgcgagctgaaagtttgtttccagtacatgaatcgtggcgaccgctggatccaggatgaaattgagtttggctacattgaggcacctcacaaaggcttcccagtagtgctggactcccctcgagatggaaacctgaaggacttccccattaagcaactcctgggcccagatttcggctatgtgacccgggagcccctctttgagactgtcaccagccttgactccttcgggaatctggaggtcagtcccccagtgaccgtgaatggcaaggcatacccgcttggccggatcctcatcgggagcagtttccctctgtctggaggcaggaggatgaccaaggtggtgcgtgacttcctgcaggcccagcaggtgcaggcgcccgtggaactctactcggattggctgactgtgggccacgtcgatgagttcatgaccttcgtccccatcccaggcaaaaaggaatttcggctgctcatggccagcacctcagcctgctaccagctcttcagagaaaagcagaaggaaggccacggggaggccattatgttcaagggtctggggggcatgagcagcaaacgaatcaccatcaataagatcctgtccaatgagagcctcacgcaggaaaaccagtactttcagcgctgtctggattggaaccgtgacatccttaagaaggagctggctctgactgagaaggacatcattgacctgcctgctctcttcaagatggatgaagaccgtcaggccagggctttcttccctaacatggtgaacatgatcgtgctagacaaggacctgggtatccccaagcctttcgggccccaggtcgaggaggagtgctgcctggagacacatgttcgaggcctgctggagcccctgggccttgcctgcaccttcattgatgacatctctgcataccacaagtttctgggagaggttcactgtggcaccaacgtgcgcaggaagcccttcaccttcaagtggtggcacatggtgccctgactgccaggggccctggccttccttccttccctgcgatctccaggtccttcctgtgtccccaagtccttcccctacaagaagcgggtgggattgggattgtgccttgctgtcccctggagaaggactttagtgtccattgaagccaccccgagtaagtccaaccgttccctacccctgaaaatagctagacatgtggttagtgtgcagaactttggaagggaaaaccagacttcaacaaatcatgtagtcgcactgtcccccaaagaattctcagcctctactccagatcagaaggaggggagagagaagggagactctgaggtcattggctcgcccagcacccatctgacattcaagatagaccaggaggaccagggccagggtcctggcgtacctcggatggtaccatcttttcaagcttacctaccttggggcctcctggtcggatccttcgcccattcattccttaaggcttcccatacacactgtgtccccaccccacccccaccccctgagggtccaatcattcagcttagaatcatccggaaatgggtcttagcagaggagaggtcttcactttctgtggattcgggctgcccaattttgggaggacggggaggtctcggactagcatccgatgtccaaagttcagtagacaaagatgcacctgtgtatcgacactatttctgttctctcccccggtcctcagttctctggccagtccgtgagcctctctttccattgttcttctgtttctgacactggccttcctattctggatgttgcccctccagcagctacagtttcttcaccaccagccagattcaggcctcccgagggcctgagaagtagccaatcccactgtccaaggatgctgaggatgctggcaatgccccagcctcactgatcacttcccggctagctactgctccagaggcagaattttccagcacactttccgaaggccttccatccagatacaggcaaatggatcccccctcccccaacctgcttcatttagaaaggcctccaggagctgtagagatggctcggcagttaaaaatgctccctgctcttcaaggggacccaagttcagttcccaacacccacggtgctctgtaactccagatccagaggatccaatacccttttctggtctctgagggcacttcacgcatgtgcacaaacccatagacataaatcaatgtttgagagtctggagagatggcccagtggttaaaagcacttgctgctcttgcggaggacctgggttcagttctcagcacccagttggtggctcacaaccaactataactctagtcccagggggtccgatgctctcctctgacctccataggcttctgcacacaggtggttcacatacacaccctcaagcacacatacaagtaaagtaaagtaaacgatgcttaaaaaatagaaacaaggaaaatatgtctcttaaaatagagaaggtccttttaaggccaagaaggtaggaaatggtaattctgctttggagggttaaacggtcccattttatagctgaagaaaagggttacacccacattcttaggggaacaagatttttaccttgcattatttcctcagtaggttgtatgctactgagtagtgggcacagacttggacgctgataacacaagctagccatagactcgcttgtcccaacagacaaaacccacgtctgcatagccaccctccgcccttgctgtggtaacactacccagtatattcaagaagcattcaggacaacagtcactgccttcaacaattaggaggtgtcctcttttctgtccagctggcctaatgcaccatgccaggtcaggccccagagcctccaaagctgtcatcctctgtctctggggacagaggttcctgcccttgagggcaaagccccaaatcctgtctcctgctccagagtggaaaacacaggcacctctctgagggaggtggtctggggatgtggcggtttgtcgtgtgtggtgttccgttaaagtggcttttactgcttttatttttatctgcgttaagaggaagtgagccctccccacgtggaggccacgacgtgtcttttgtaggttgtgttggtgtttggggaatttctggaactccaggactccgcctgtcccatctcacttactcacccagtgtgaccccctcaagtgtggacgccccatcccgaggactccttgctcttctccacctccattgtttgttggtgttttttttttttaaacttatgcccagaggcttctgggctatgccagttcctgtttcaatgttaattttgaaatgctctgctgagggtgggggtaacggcaggaagatggcgggaatggggcagtatgaacttcctggaaaaaaagccaagatggagtctgaggagtgtctgggggaagagccaaaataaagagcaataaaataagccgtc

SEQ ID NO: 1975 - DNA, 1638 bp, Rattus norvegicus
  Genbank Accession No. NM_017231
gcgggaggtggcgaggccagggcagggtggcagaagcccgcgcggcgaccgcagcgagagcagcggggacagagcagaccacaacgaaggcgcacaggcagcggggccgggccgggccaccgggagagcggccaccgggaagcgggcgggaggccgggctggcagctggcagccgccgagccgcgaagcgacatggtgctgctcaaggaatatcgggtcatcctgcctgtgtctgtagatgagtatcaagtggggcagctgtactctgtggctgaagccagtaaaaatgaaactggtggtggggaaggtgtggaggtcctggtgaacgagccctacgagaaggatgatggcgagaaaggccagtacacacacaagatctaccacttacagagcaaagttcccacgtttgttcgaatgctggccccagaaggcgccctgaatatacatgagaaagcctggaatgcctacccttactgcagaaccgttattacaaatgagtacatgaaggaagactttctcattaaaattgaaacctggcacaagccagaccttggcacccaggagaatgtgcataaactggagcctgaggcatggaaacatgtggaagctatatatatagacatcgctgatcgaagccaagtacttagcaaggattacaaggcagaggaagacccagcaaaatttaaatctatcaaaacaggacgaggaccattgggcccgaattggaagcaagaacttgtcaatcagaaggactgcccatatatgtgtgcatacaaactggttactgtcaagttcaagtggtggggcttgcagaacaaagtggaaaactttatacataagcaagagaagcgtctgtttacaaactttcacaggcagctgttctgttggcttgataaatgggttgatctgactatggatgacattcggaggatggaagaagagacgaagagacagctggatgagatgagacaaaaggaccccgtgaaaggaatgacagcagatgactagcgctaccgccctttctgcactttttgcaagacagtggtccacaggaaggcccagcagctccaccctcctgagtggcaggccatctttggacgcagcctttctgtgctcattcttcaggcaactttcagtcccttactatagctatttctagatgccctttaacattgtgaacaaatagaccgtctggtattataaagcctgtgtgtgcgggagcctgatcctctaagatatatggtgtatgctgctgtatttacagctcatcctctctccattgtgccctgacccatttctgtatgccctccccctttatttccaagtgacgttctcattctttcaaatgtgctgcctttgtgatgtgattatttaagctcacttatttcagccttgggataagctgagctattttgcttcctgggcagatctttggcaatgttgaatattcacttggggagagaggaggagttaaaaatacagagacacctaccctagctcctcacaataggaatgtggcttcagaaccctgacctctgctcctagtaacctcttgttcgcgtgctctaagcaccaagaaggcacccaaggcccagccagtctaagaaaatttagcaaataataaataacccctactcg

SEQ ID NO: 1976 - DNA, 4404 bp, Rattus norvegicus
  Genbank Accession No. NM_017232
  misc_feature (1)..(4404): n = a or c or g or t
cttcaggagtacgaagaccctgcctacgaaggaactcagctctgtgttcctgccagctcccccgccagcttcacttgccaccaacgctgccacaactgctgccaccaccgctgccacctctgcgatgctcttccgagctgtgctgctctgcgcttgccctggcctcagccatgcagcaaatccttgctgttccaacccatgtcaaaaccgtggtgaatgtatgagcataggatttgaccaatataaatgtgactgtacccggactggattctacggtgaaaactgtactacgccgagattcctgacaagaatcaaattaccgctgaagcccaccccaaacacagtacactacatcctgacccacttcaagggagtctggaacattgtgaacaacattcccttccttcgaattcaatccatgagatacgtgttgacgtccagatcacatttgattgacagcccaccaacttacaatgtgcactacggttacaaaagttgggaagctttctccaacctctcctactacaccagggcccttcctcctgtggctgatgactgcccaactcccatgggtgtgaaaggaaataaggaacttcctgattcaaaagaagttctggaaaaggttcttctgaggagagagttcatcccggatccccaaggcacaaatatgatgttcgcattctttgcccagcacttcactcatcagtttttcaagacagatcagaagcgaggacctgggttcacccgaggactgggccatggagtggacttaaatcatgtttacggtgaaactctagacagacaacataaacttcgacttttccaggatggaaaattgaaatatcaggtcatcggtggagaggtgtatcctcccacagtcaaagacactcaggtagacatgatctaccctccccacgtccctgagcacctgcggttcgctgtggggcaggaagtctttggtctggtgccgggtctgatgatgtatgctaccatctggcttcgggagcacaacagagtgtgtgatattctcaaacaggagcatcctgagtgggatgacgagcgactgttccaaaccagcaggctcatactgataggagagacgatcaagatagtgatcgaagactacgtgcaacacctgaggggttaccacttccaactcaagttcgacccagacctgcttttcaaccagcagttccagtatcagaaccgcattgcctctgaattcaagacactctatcactggcatccgctgctgccggacaccttcaacattgaagaccaggagtacactttcaaacagtttctctacaacaactccatcctccttgaacacggacttgctcactttgttgagtcattcaccagacagattgctggccgggttgctgggggaaggaatgttccaatcgctgtacaagcagtggcaaaggcctccattgaccagagcagagagatgaaataccagtctctcaatgagtaccgcaaacgcttctccctgaaaccttacacatcgtttgaagaacttacaggagagaaagaaatggctgcagagttgaaagccctctaccatgacatcgatgccatggaactgtatcccgccctgctggtggaaaagcctcgnccagatgctatctttggggagaccatggtagaacttggagctccattctccttgaaaggccttatgggtaatcccatctgttctcctcaatactggaaacctagcaccttcggaggagaagtggggtttaggatcatcaacactgcctcaattcagtctctcatctgcaataatgtgaaagggtgtcccttcgcctctttcaatgtgcaagacccgcaggctaccaagacagccaccatcaacgcaagtgcctcccactccagactagatgacattaaccctacagtactaatcaaaaggcgttcaactgagctgtaagagtctactgaccatatttatttatttatatgaacaatttaatttaattatttaatattatacagaatgcttttttttcacttaacatcttctataacagaaggcaatattcttgaacaatgttccatttgtgaagattcctgtgttgtacttttaaatatggttatccgaaagtgaaagggaaaaaaaagaacactttcatttttcggcataagccagtgagaagggaaatgaattttgatatctttatacttgaatgtcagctcatgactagccttaattaagaacaaatgaaaggtgtatgaatatttaaatgctgttacaaggagggaaatgtgaatatttaaatgctgttacaaggagggaaatgctgcattgttggttatgactgtgtcatccttactatgttaggagcaaccgatgtggaattgtttttaaatcttgcatatctttatctcatcaaagcaaaggggtacaagtccagttttaaatgaacatgaaggcagataccggcaactgtctttttattttttaaaagcaatctttgaaacaaatgatttgcaatgtctaaatcgggagttggaatcactttcgaaagcccttactttcttgagctgtcaaatttgtacccacacagattaagcagctaccataaacacaaatctaaaactggggaaaactattatgactgatggttaagataccatgtcagggatctttcttttctcaggagtagtgaaaagctactatgacaatcagaccttccttgtacgtcagattgctggcgtaggaaggtggcggagcccgtgatgttctgtcctaaacgatggaaaagctttaaagcttgtgtgtgagtggtagccagcaaaacctatcatagcaacaaaagagtccacaaacaaaataaccaagaacaaagaagggttcccaagcttaaagaccgcatcgagggttaaactttttggaagggagacttttcagatcctcctgtgggtgcttggcttgtgactttggcaggctggattttaaagagtttttctgttgcacagtatgacacaacagcccatctctcaatgcaaaaggtatcagtgggcttcttcaaaactttgaaatgtcttccagctcacggtaccagaagtgcagtaggccccatgcaatgtgtgagttcagcctggatgccagcatgatgctctccttactctgtttcttgtagtcattttgctctgagaaactgctgattgatctgtttttgtagctgtgttccaggctcttagtattctttctttaacctccattaatattttctctacttgaagttttacattcaggaaaaacctcagctcaggactactgtgtagctccccttcggaggaagaagttactttagacaaaagggaaaaaaaattaaatgtatttttcatttgtaattaaatggaagggccctaccaagattctagaattggagggggttctgacaagaaagttacattcttgtcctgaagaattgctttcttatttaaaaacagagtcagttagtgggtagttctgggcaatagaaataaatataaaacaataatgacaatcattctctacatctcattatcagctgaggtactgtatattactgaatttactgaagatagttatgtctttcagacattgttgttataaactatgtttaagcctactacaagtgtttcttttttgcattatgtcagaattgatgtaccttttttttaatgattacctccctgtactactgtgcgaacaatcaaacaaaatgatgagattaatggtcatggataaatttcaagaaaactagtgtatttgattgaaaagtttaaagttagaacttaggccattggaatttactcatatagcaaactgcgtagagccaatattgactcacctacacacgttatacagattgacattttagacatttggaaggccccgtaggtattttattagttagaacttaattttttgaaaaaacatatccaaagcacaataggcattagaatttgtgcatcgagaactgattacaaataatattgatatgtatgtaaataactgagaagtatgtcttatgaagaaatatattttattacaaaaaattataaaacattttcaagattatatgctttaaaagtttaagatcagaaaataatcaactttagaaaaacacgtttaaaaattgttaacatcattgattaaaaaaaaaaaaaaaaaagccaacatgattgttgtgaacatcaacctgctgactgaacctgggaattcaggttaagtatgtgactgctgccgtgcctcagagaaatttgtatttaaattaacttatgtaaaaaaaaatcttagaacaaatgtttgtttatttttatacttatttaagaaattgaaaacttctgaaaataaagtttgattgtgtctttaaaaaaaaaaaaaaaaaaaaaaaaaaaaaaaaa

SEQ ID NO: 1977 - DNA, 1075 bp, Rattus norvegicus
  Genbank Accession No. NM_017236
gtttaactgcactcgggactcggcgcgcgcgtgtgtctgttctctccatcgtcatggccgccgacatcagccagtgggccgggccgctgtcattacaggaggtggatgagccgccccagcacgccctgagggtcgactacggcggagtaacggtggacgagctgggcaaagtgctgacgcccacccaggtcatgaatagaccaagcagcatttcatgggatggccttgatcctgggaagctctacaccctggtcctcacagaccccgatgctcccagcaggaaggaccccaaattcagggagtggcaccacttcctggtggtcaacatgaagggcaacgacattagcagtggcactgtcctctccgaatacgtgggctccggacctcccaaagacacaggtctgcaccgctacgtctggctggtgtatgagcaggagcagcctctgaactgtgacgagcccatcctcagcaacaagtctggagacaaccgcggcaagttcaaggtggagtccttccgcaagaagtaccacctgggagccccggtggccggcacgtgcttccaggcagagtgggatgactctgtgcccaagctgcatgatcagctggctgggaagtaggggcgctgcagagcccgcagccccggggaccccacagtacagtcaagtcgtataaagcatgtctgtggggtgtccccccacgcccatccttccttcccaccctctcatagggagttctcagttgtgctaggttacagctctaggatgtcttccactttgtccaggaccaggcccagtaacatcttttggggtgggcttatcaatcctcccatctcggctgagccctgaccgcccaggtcagatggctgcatagttatcaatattcctgggctgctgctacgcagtgctgctgtgtggaggccaggctgtggagagagaccctgttagccccttacatcccagtgggataagcaaaagtcaccggagttgctgggcgtgttaaacctcatcaaatacaaataaagggcattgcattcagaaaaaaaaaaaaaaaaaaaaaaaaaaaaaaaaaaaaaaaa

SEQ ID NO: 1978 - DNA, 5930 bp, Rattus norvegicus
  Genbank Accession No. NM_017239
tctgtgaaaagattaaccggagtttaagagtgataggatgacggatgcccagatggctgacttcggggcggcacgatacctccgcaagtcagagaaggagcgcctagaggcccagacccggccctttgacatccgcacagagtgcttcgtgcctgatgacaaggaggagtatgtcaaggccaagatcgtgtcccgggaagggggcaaggtcactgccgaaactgaaaacggcaagacggtgactgtgaaggaggaccaggtgatgcagcagaaccctccgaaattcgacaagatcgaggacatggccatgctgaccttcctgcatgagccagctgtgctctacaatctcaaggagcgctatgcggcctggatgatctatacctactcaggcctcttctgtgtcaccgtcaacccctataagtggctgccagtgtacaatgcggaagtggtagctgcctaccggggcaagaagaggagcgaggctccaccccacatcttctccatctctgacaacgcctatcagtacatgctgacagatcgggagaaccagtccatcctcatcactggagaatccggagcggggaagactgtcaacacgaagcgtgtcatccagtactttgctagcattgcagccataggggaccgtagcaagaaggacaatcctaatgcaaacaagggcaccctggaggaccagattatccaggctaaccctgctctggaggcctttggcaacgccaagactgtccggaatgacaactcctcccgctttgggaagttcatcaggatccactttggagccacaggaaagctggcttctgcagacatagagacctaccttctggagaagtcccgggtgatcttccagctaaaggctgagaggaactaccatatcttctaccagatcctgtccaacaagaagccggagctgctggacatgctgctggttaccaacaacccgtacgactatgccttcgtctctcagggagaggtgtctgtggcctccattgatgactccgaggagcttttggccactgatagcgcctttgatgtgctgggcttcacagcagaggagaaggccggtgtctacaagctgacaggcgccatcatgcactatgggaacatgaagttcaagcagaagcagcgggaggagcaggcggagccagacggcacagaagatgctgacaaatctgcctacctcatggggctgaactcagccgacctgctcaagggtctgtgtcaccctcgggtgaaggtgggtaacgagtatgtcaccaaggggcagagtgtacagcaggtgtactattccatcggggcactggccaagtcagtgtacgagaagatgttcaactggatggtgacacgcatcaacgcaaccctggagaccaagcagccacgccagtacttcataggtgtcctggacatcgccggctttgagatctttgatttcaacagctttgagcagctgtgcatcaacttcaccaatgagaagctgcagcagttcttcaaccaccacatgttcgtgctggagcaggaggagtacaagaaggaaggcatcgagtgggagttcattgacttcggcatggacctgcaggcctgcatcgacctcatcgagaagcccatgggcatcatgtccatcctggaggaggagtgcatgttccccaaggccacagacatgaccttcaaggccaagctgtacgacaaccacctgggcaagtccaacaacttccagaagcctcgcaatgtcaaggggaagcaggaagcccacttctctctggtccactatgctggcaccgtggactacaacatcttgggctggctggagaagaacaaggaccctctcaacgagacggtggtggggctgtaccagaagtcctccctcaaactcatggccacactcttctccacctatgcttctgctgataccggtgacagtgggaaaggcaaaggaggcaagaagaaaggctcatccttccagacagtgtctgctctccaccgggaaaatctgaacaagctgatgacaaacctgaggaccacccatcctcactttgtgcgctgcatcatccccaatgagcggaaggctccaggggtgatggacaaccccctggtcatgcaccagctgcgatgcaacggagtgctggagggtatccgcatctgtaggaagggcttccccaaccgcattctttatggggacttccggcagaggtatcgaatcctgaacccagcagccatccctgagggccaattcattgatagcgggaaaggggctgagaagctgctgggctccctggacattgaccacaaccagtacaagtttggccacaccaaggtgttcttcaaggcggggctgctggggctgctggaggagatgcgagatgagaggctgagccgcatcatcaccagaatccaggctcaagcccgaggccagctcatgcgcattgagttcaagaagatggtggagcgcagggacgccctgctggttatccagtggaacatccgcgccttcatgggggtcaagaattggccgtggatgaagctctacttcaagatcaagccgctgctgaagagcgcagagacagagaaggagatggccaacatgaaagaggagttcgggcgagtcaaagatgcactagagaagtctgaggctcgccgcaaggagctggaggagaagatggtgtccctgctgcaggagaagaatgacctgcagctccaagtgcaggcggaacaagacaacctggcagatgccgaggagcgctgcgaccagctgatcaagaacaagatccagctggaggccaaggtgaaggagatgaccgagaggctggaggacgaggaggagatgaacgccgagctcacggccaagaagcgcaagctggaagacgagtgctcagagctcaagaaagatatcgatgacctggagctgaccctggccaaggtggagaaggaaaagcacgcaacagagaacaaggttaaaaacctgacagaggagatggccgggctggacgagatcattgccaagctgaccaaggagaagaaagctcttcaagaggcccaccagcaagccctagatgaccttcaggctgaggaagacaaggtcaacacactgaccaagtctaaagtcaagctggagcagcaggtggatgatctggagggatccctggagcaggagaagaaggtgcgcatggacctggagcgagcaaagcggaagctggagggtgacctgaagctgacccaggagagcatcatggacctggagaacgacaagcttcagctggaggaaaagctcaagaagaaagagtttgacatcagtcagcagaacagtaaaatagaggacgagcaggccctggcccttcagctgcagaagaaactgaaggaaaaccaggcacgcatcgaggagctggaggaggagctagaggcggagcgcacagcccgggccaaggtggagaagctgcgctcagacctgacccgggagctggaggagatcagtgagaggctagaggaagccggtggggccacatctgtgcagatagagatgaacaagaagcgcgaggccgagttccagaagatgcggcgggacctggaggaagccacgctgcagcatgaggccacagccgcggccctgcgcaagaagcacgcagacagcgtggccgagctgggcgagcagatagacaatctacagcgggtgaagcagaagctggagaaagagaagagcgagttcaaactggagctggatgacgtcacctctcacatggagcagatcatcaaggccaaggcaaacctggagaaagtgtcccggacactggaggaccaggcgaatgaataccgggtgaagttggaagaagcccagcgctccctcaatgacttcaccacacagcgagccaagctgcagacagagaatggcgagttggctaggcaactggaagaaaaggaggcactgatttggcagctgacccggggcaagctctcctatacccagcagatggaggacctcaagaggcagctggaggaggaaggcaaggccaagaatgccttggcccacgcactgcagtcagcccggcatgactgcgacctgctgcgggaacagtacgaagaagaaatggaggccaaggccgagctgcagcgtgtcctgtccaaggccaactcagaggtggcccagtggaggaccaagtatgagacggacgccatacagaggacggaggagctggaggaagccaagaagaagctggctcagaggcttcaggatgctgaggaggcagtggaggccgtcaacgccaagtgctcctcgctggagaagaccaagcacaggctgcagaacgagatcgaggacctgatggtggatgtggagcgctccaatgcggccgccgcagccctggacaaaaagcagaggaacttcgacaagatcctggctgagtggaagcagaagtatgaggagtcccagtcagagctggagtcttcccagaaggaggcgcgctccctgagcacagagctcttcaagctcaagaatgcctatgaggagtctctggagcacctggagaccttcaagcgggagaacaagaacctccaggaggagatctcagacctgactgaacagctgggagaagggggtaaaaatgtgcacgagctggagaagatccgcaaacagctggaggtggagaagctggaactgcagtcagccctggaggaggctgaggcctccctggagcatgaggagggcaagatcctccgagcccagctggagttcaaccagatcaaggcagagatcgaaaggaagctggcagagaaggacgaggagatggagcaggccaagcgcaaccacctgcgggtggtggactccctacagacctccctggatgccgagacacgcagccgcaacgaggccctgcgggtgaagaagaagatggagggcgacctcaatgagatggagatccagctcagtcaggccaatagaatagcctcagaggcccagaagcacttgaagaacgcccaagcccacttgaaggacacccagctccagctggatgacgcagtccgtgccaatgacgacctgaaggagaacatcgccatcgtggagcggcgcaacaccctgctgcaggcggagctggaggagctgcgggccgtggtggagcagacagagcggtctcggaagctggcagagcaggagctgatcgagaccagcgagcgggtgcagctgctgcactcccagaacaccagcctcatcaaccagaagaagaagatggatgcagacctctcccagctccagacagaggtggaggaggcggtgcaggagtgtaggaacgcagaggagaaggccaagaaggccatcacagatgccgccatgatggccgaggagctgaagaaggagcaggacaccagcgcccacctggagcgcatgaagaagaacatggagcagaccatcaaggacctgcagcaccggctggacgaggcagagcagatcgccctcaagggtggcaagaagcagctgcagaaactggaggcccgggtccgggagctggagaatgagctggaggctgagcagaagcgcaatgcggagtcggtgaagggcatgaggaagagcgagcggcgcatcaaggagctcacctaccagacagaggaagacaagaagaacttggtgcggctgcaggacctggtggacaagctgcagttgaaggtgaaggcctacaagcgccaggctgaagaggcggaggaacaggccaacaccaacctgtccaagttccgcaaggtgcagcacgagctggatgaggcagaggagagggcggacattgccgagtcccaggtcaacaagctgcgggccaagagccgtgacattggcgccaagcagaaaatgcacgatgaggaataacctgtccagcagaaagagcctcgctgttgctatcccacaataaatatgaatgcttgactttgcctgtaaaaaaaaa

SEQ ID NO: 1979 - DNA, 5925 bp, Rattus norvegicus
  Genbank Accession No. NM_017240
ccgctcagtcatggcggatcgagagatggctgcatttggggccggagcccccttcctgcgaaaatctgagaaggagcggctggaggcgcagaccaggccctttgacctcaagaaagatgtttttgtgcctgatgacaaagaagagtttgtcaaggccaagatcgtgtctcgagagggtggcaaagtcaccgctgagacagagaatggcaagacggtgactgtgaaggaggaccaggtgatgcagcagaaccctcccaagttcgacaagatcgaggacatggccatgctgaccttcctgcacgagccggctgtgctctacaatctcaaggagaggtacgcttcctggatgatctacacctactcaggcctcttctgtgtcaccgtcaacccctataagtggctgccagtgtacaatgcgcaagtggtagctgcctaccggggcaagaagaggagcgaggctccaccccacatcttctccatctctgacaacgcctatcagtacatgctgacagatcgggagaaccagtccatcctcatcaccggagaatccggagctggtaagaccgtcaacaccaagagggtcatccaatattttgctgttattgctgccattggggaccgcagcaagaaggaccagaccccaggcaagggcaccttggaagatcaaatcatccaagccaaccccgctctggaggcctttggcaatgccaagacagttcggaatgataactcctcccgatttgggaaattcattcgaatccattttggggcaacaggaaagttggcatctgcagatatagagacctaccttctggaaaaatccagagttattttccagctgaaagcagaaagagattatcacattttctaccaaatcctgtctaataaaaagcctgagcttctagacatgctgctgatcaccaacaacccctacgattatgcgttcttctcccagggagagacgactgtggcctcaatagatgactctgaagagcacatggccaccgatagcgcctttgatgtgctgggcttcactccagaagagaagaactccatttacaagctgacaggcgccatcatgcactttggaaacatgaagttcaaacagaagcagagggaggagcaggcagagccagacggcacggaagaagctgacaagtcagcctacctcatgggactgaactcggctgacctgctcaaggggttgtgccaccctcgagtcaaagtgggcaacgagtatgtcaccaaagggcagaatgtccagcaggtggcatatgccatcggggcactggccaagtcagtgtacgagaagatgttcaactggatggtgacacgcatcaacgcaaccctggagaccaagcagccacgccagtacttcataggtgtcctggacatcgccggctttgagatctttgatttcaacagctttgagcagctgtgcatcaacttcaccaatgagaagctgcagcagttcttcaaccaccacatgttcgtgctggagcaggaggagtacaagaaggaaggcatcgagtggacgtttattgacttcggcatggacctgcaggcctgcatcgacctcatcgagaagcccatgggcatcatgtccatcctggaggaggagtgcatgttccccaaggccacggacatgaccttcaaggccaagctgtacgacaaccacctgggcaagtccaacaacttccagaagcctcgcaatatcaagggaaagcaggaagcccacttctctctgatccactatgctggcaccgtggactacaatatcctgggctggctacagaagaacaaggaccctctcaatgagacggtggtggggctgtaccagaagtcctccctcaagctcctaagtaatctgtttgccaactatgctggagctgatgcacctgtagacaagggcaaaggcaaagcaaagaaaggctcatcctttcagaccgtgtccgcactgcacagggaaaatctgaacaaacttatgacaaacctgcgctccacgcaccctcactttgtacgctgcatcatccccaatgagacgaagtctccaggggtgatggacaaccccctggtcatgcaccagctgcgatgcaacggagtgctggagggtatccgcatctgtaggaagggcttccccaaccgcattctttatggggacttccggcagaggtatcgaatcctgaacccagcagccatccctgagggccaattcattgatagccggaaaggggctgagaagctgctgggctccctggacattgaccacaaccagtacaagtttggccacaccaaggtgttcttcaaggcggggctgctggggctgctggaggagatgcgagatgagaggctgagccgcatcatcaccagaatccaggcccagtcccgaggtgtactttccagaatggagtttaagaagctgctggagcgcagagactccctgctgattatccagtggaacatccgcgccttcatgggggtcaagaattggccgtggatgaagctctacttcaagatcaagccgctgctgaagagcgcagagacagagaaggagatggccaacatgaaggaggagttcgggcgagtcaaagatgcactagagaagtctgaggctcgccgcaaggagctggaggagaagatggtgtccctgctgcaggagaagaatgacctgcagctccaagtgcaggcggaacaagacaacctggcagatgccgaggagcgctgcgaccagctgatcaagaacaagatccagctggaggccaaggtgaaggagatgaccgagaggctggaggacgaggaggagatgaacgccgagctcacggccaagaagcgcaaactggaagacgagtgctcagagctcaagagagatatcgatgacctggagctgaccctggccaaggtggagaaggaaaagcacgcaacagagaacaaggtgaaaaacctgacagaggagatggctgggctggacgagatcattgtcaagctgaccaaggagaagaaagctctacaagaggcccaccagcaagccctagatgaccttcaggctgaggaggacaaggtcaacactctgaccaaggccaaggtcaagctggagcagcaagtggatgatctggagggatccctggatcaggacaagaaggtgcgcatggacctggagcgagcaaagcggaagctggagggtgacctgaagctgacccaggagagcatcatggacctggagaacgacaagcagcagttggatgagcgactcaaaaagaaggactttgagttaaatgcactcaacgccaggattgaggatgagcaggccctgggcagccagctgcagaagaagctcaaagagcttcaggcacgcatcgaggagctggaggaggagctggaggctgagcgcacagcccgggccaaggtggagaagctgcgctcagacctgtcccgggagctggaggagatcagtgagaggctagaggaagccggtggggccacatctgtgcagatagagatgaacaagaagcgcgaggccgagttccagaagatgcggcgggacctagaggaggccacgctgcagcatgaggccacagctgcggccctgcgcaagaaacacgcggacagcgtggccgagctgggcgagcagatagacaatctacagcgggtgaagcagaagctggagaaagagaagagcgagttcaagctggagctggatgacgttacctccaacatggagcagatcatcaaggccaaggctaacctggagaagatgtgccggaccctggaggaccagatgaatgaacaccggagcaaggctgaggagacacagcgttctgtcaatgacctcacccgccagcgggccaagctgcagacagagaatggggagctgtccagacagctggatgagaaggaggctcttatctctcagctgacccgaggcaagctcacgtatacccagcagctggaggacctcaagaggcagctggaggaggaggtcaaggccaagaatgccctggcccacgcactgcagtcagcccggcatgattgcgacctgctgcgggaacagtacgaggaggaaacagaagccaaggctgagctgcagcgtgtcctgtccaaggccaactcagaggtggcccagtggaggaccaagtatgagacggacgccatacagaggacggaggagctggaggaagccaagaagaagctggctcagaggcttcaggatgctgaggaggcagtggaggccgtcaacgccaagtgctcctcgctggagaagaccaagcacaggctgcagaacgagatcgaggacctgatggtggatgtggagcgctccaatgcggccgccgcagccctggacaagaagcagaggaacttcgacaagatcctggttgagtggaagcagaagtatgaggagtcccagtcagagctggagtcttcccagaaggaggcgcgctccctgagcacagagctcttcaagctgaagaatgcctatgaggagtctctggagcacctggagaccttcaagcgggagaacaagaacctccaggaggagatctcagacctgactgaacagctgggctcaactgggaagagcatccacgagctggagaagatccgaaagcaactggaggctgagaagctggagctgcagtcagccctggaagaggctgaggcctccctggagcatgaggagggcaagatcctccgagcccagctggagttcaaccagatcaaggcagagatcgaaaggaagctggcagagaaggacgaggagatggagcaggccaagcgcaaccacctgcgggtggtggactccctgcagacctccctggatgccgagacgcgcagccgcaacgaggccctgcgggtgaagaagaagatggagggcgacctcaacgagatggagatccagctcagtcatgccaaccgcatggctgctgaggcccagaaacaagtgaagagcctccagagtttgctgaaggacactcaaatccagctggatgacgcagtccgtgccaatgacgacctgaaggagaacatcgccatcgtggagcggcgcaacaacctgctgcaggcggagctggaggagctgcgggccgtggtggagcagacggagcggtctcggaagctggcagagcaggagctgatcgagaccagcgagcgggtgcagctgctgcactcccagaacaccagcctcatcaaccagaagaagaagatggatgcagacctctcccagctccagacagaggtggaggaggcggtgcaggagtgtaggaacgcagaggagaaggccaagaaggccatcacagatgccgccatgatggccgaggagctgaagaaggagcaggacaccagcgcccacctggagcgcatgaagaataacatggagcagaccatcaaggacctgcagcaccggctggacgaggcagagcagatcgccctcaagggtggcaagaagcagctgcagaagctggaggcccgggtccgggagctggagaatgagctggaggctgagcagaagcgcaatgcggagtcggtgaagggcatgaggaagagcgagcggcgcatcaaggagctcacctaccagacagaggaagacaggaagaacctactgcgactgcaggacctggtggacaagctgcagttaaaggtgaaggcctacaagcgccaggctgaggaggcggaggaacaggccaacaccaacctgtccaagttccgcaaggtgcagcacgagctggatgaggcagaggagagggcggacattgccgagtcccaggtcaacaagctgcgggccaagagccgtgacattggcgccaagggcctgaatgaagagtagatcttgtgctacccaaccctaaggatgcctgtgaagccctgagacctggagcctttgaaacagcaccttaggcagaaacacaataaagcaattttccttcaagccaa

SEQ ID NO: 1980 - DNA, 2626 bp, Rattus norvegicus
  Genbank Accession No. NM_017245
cgcttccctgttcacctctgtatttgagaatccgacgccatctgccaccatggtgaacttcacagtagatcagatccgtgccatcatggacaagaaagccaacatccggaacatgtcagtcatcgctcacgtggaccacggcaagtccacgttgaccgactcccttgtgtgcaaggctggcatcatcgcctctgcccgagccggtgagacacgcttcactgacactcgaaaggatgagcaggagcgctgcatcaccatcaagtccactgccatctccctcttctatgagctctccgagaacgacctgaacttcatcaagcagagcaaggatggctctggcttcctcatcaacctcattgactctccaggtcatgtggacttctcctcagaggtgaccgctgctctgcgtgtcactgatggagcactggtggtggtggactgtgtgtctggtgtctgtgtgcagacagagacagtgctgcggcaggccatcgctgagcgcatcaagcccgtgctgatgatgaacaagatggaccgggccctgctggaactgcaactggagcctgaggagctctaccagaccttccagcgcatcgtggagaacgtcaatgtcatcatctccacctatggcgagggcgagagtggacccatgggcaatatcatgatcgatcctgtcctgggcactgtaggctttggctctggcctgcatgggtgggccttcacactgaagcagtttgcagagatgtatgtggccaagtttgcagccaagggtgagggccagctgggtgcagctgagcgggccaagaaggtagaagacatgatgaagaagctgtggggagaccggtattttgacccggccaacggcaagttcagcaagtcagccaatagcccagacgggaagaaacttccccgcaccttctgccagctcatcttggaccccatcttcaaggtgtttgatgccatcatgaacttcagaaaggaggagacagccaagctgatcgagaagctggacatcaagctggacagtgaggacaaggacaaggagggcaaaccactgctgaaggctgtgatgcgtcgctggctccctgctggtgacgccctgctacagatgatcaccatccacttgccgtccccggtcactgcacagaagtaccgttgtgagctgctgtacgagggcccacctgatgacgaggccgccatgggtattaagagctgcgaccccaaaggccccctaatgatgtacatctccaagatggtgccaacatctgacaaaggccgcttctatgccttcggtagagtgttctctggggtggtgtccacaggtctgaaggtccggatcatgggccccaactatacacctgggaagaaggaggacctgtacctgaagcctatccagaggaccattctgatgatgggccgctatgtggaacccattgaggatgtgccctgtggcaacattgtggggttggtcggggtggaccagttccttgtgaagaccggcaccatcactacctttgagcacgctcacaacatgcgggtgatgaagttcagcgtcagccctgtagtcagggtggcagtggaggccaagaacccagctgacctgcccaagctggtggaggggctgaagcggctggctaagtctgaccctatggtgcagtgcatcatcgaggagtctggggagcacatcattgctggtgctggagagctgcacctggagatctgccttaaggacctggaggaggaccatgcctgcatccccatcaagaaatctgaccctgtcgtgtcctaccgggagacagtcagtgaggagtccaacgtgctctgtctttccaagtccccaaacaagcacaacaggctgtacatgaaggccaggcccttccctgatggcctagcagaggacatcgataagggtgaggtatctgcccgccaggagctcaaggcgcgtgcccgttacctggccgaaaagtatgagtgggatgttgctgaagcccgcaagatctggtgctttggacctgatggcactggtcccaacattctcaccgacatcaccaagggtgtgcagtacctgaatgagatcaaggacagtgtggtggctggattccagtgggccactaaggagggtgctctttgtgaggagaacatgcgtggtgtgcgatttgatgtccatgatgtgaccctgcatgctgatgccatccaccgaggaggtggtcagatcatccccacagcgcgccgctgcctctatgccagtgtgctgactgcacagccccgcctcatggagcctatctacctggtggagattcagtgtcctgagcaagtggtgggcggaatctatggtgtcctcaacaggaagcgtggccatgtctttgaggagtcccaggtagctgggacccccatgttcgtggtcaaggcctacctgcctgtcaatgaatcctttggcttcactgccgaccttcgatccaacactggtggccaggccttcccccagtgtgtgtttgaccactggcagatcctgcctggggacccctttgacaacagcagccgccccagccaagttgtagctgagacccgcaagcgcaaaggcctgaaggagggcatcccagcgctggacaacttcctggacaaactgtag

SEQ ID NO: 1981 - DNA, 1696 bp, Rattus norvegicus
  Genbank Accession No. NM_017248
cgctgaacgctctcatcatcctaccgtcatgtctaagtcagagtcccccaaggaaccggaacagctgcggaagctcttcattggagggctgagcttcgaaacaaccgacgagagtctgaggagccattttgagcaatggggaacactcaccgactgtgtggtaatgagagatccaaacaccaaaagatccagaggctttgggtttgtcacatatgccactgtggaggaagtggatgctgccatgaatgcaagaccacacaaagtggatggaagagttgtggaacctaagagagctgtgtcaagagaagattctcagagaccaggtgcccacttaactgtgaagaagatctttgttggcggtattaaagaagacactgaagaacatcacctacgagattattttgagcagtatgggaaaattgaagtgattgaaattatgactgacagaggcagtggaaaaaagaggggatttgcgtttgtcacctttgatgaccatgactctgtggataagattgttattcagaaataccatactgtgaatggccacaactgtgaagtaagaaaggctctgtgcaaacaagagatggctagtgcttcatccagccagagaggtcgaagtggttccggaaactttggtggtggtcgtggaggtggtttcggtggcaatgacaattttggtcgaggagggaacttcagtggtcgtggtggctttggtggcagccgtggtggtggtggatatggtggcagtggggatggctataatggatttggcaatgatggaagcaattttggaggtggtggaagctacaatgattttggcaattacaacaaccagtcatcaaattttggaccgatgaaaggaggaaactttggaggcaggagctctggcccttatggtggtggaggccagtactttgctaaaccacgaaaccaaggtggctatggaggttccagcagcagcagtagctatggcagtggcaggaggttctaattacagccaggaaacaaagcttagcaggagagccagagaagtgacagggaagctacaggttacaacagatttgtgaactcagccaagcacagtggtggcagggcctagctgctacaaagaagacatgttttagacaatactcatgtgtgtgggcaaaaactccaggactgtatctgtgactaattgtataacaggttattttagtttctgttctgtggaaagtgtaaagcattccaacgaagggttttactgtagacctttttcacccatgctgttgattgctaaatgtaaaagtctgatcatgacgctgaataaatgtgtcttttttttttttttttaatgtgctgtgtaaagttagtctactctgaagccatcttggtaaacttccccaacagtgtgaagttagaattccttcagggtggtgccaaattccatttggaatttatttatggttgcttgggtggagaagccattgtcttcaaaaaccttggtgttgctaaactgccagttactgttgtaacttaatgagtttcaccatttaaagggtcatccaagcaagatcacaatttggttataaaatggttgttggacacctatgaagagaaaattgaataacggtctcagataaaataagagatgggaatgaagcttgtgtatcatccattatcatgtgtactcaataaacgatttaattctcttgaatgg

SEQ ID NO: 1982 - DNA, 1250 bp, Rattus norvegicus
  Genbank Accession No. NM_017252
gaccatggccacagctgcctcgaatccctacagcattctcagttccagctccctcgtccatgcggactctgcgggcatgcagcagggaagtcctttccgcaatcctcagaaacttctccaaagtgactacttgcagggagttcccagcaatgggcatcccctcgggcatcactgggtgaccagtctgagcgacgggggcccgtggtcctccacattggccaccagccccctggaccagcaggacgtgaagccgggacgtgaagatctgcaactgggagcaatcatccatcaccgctcgcctcacgtagcccaccactcgccccacactaaccatccgaacgcctggggagcgagcccggctccaaactcgtccatcacgtccagcggccaacctctcaatgtgtactcgcagccaggcttcacggtgagtggtatgctagagcacgggggactcactccaccaccagctgctgcctccacacagagcctgcatccagtgctccgggagcctccagaccatggtgagctgggctcgcaccactgccaggaccactcggatgaagagactccaacctctgatgagttggaacagttcgccaaacaattcaaacaaagaagaatcaagttgggtttcacgcaagccgacgtggggctggcattgggcacactgtatggcaacgtgttctcccagactaccatctgcaggttcgaggccttgcaactgagcttcaagaacatgtgcaagctgaaaccactgctaaataagtggctggaggaggctgattcatccacaggaagcccgaccagcattgacaagatcgccgctcagggccgtaaacgcaagaagcgaacctccattgaggtgagtgtcaagggcgtactggaaacgcatttcctcaagtgtcccaagcctgcagcacaggagatctcctcgctggcagacagtctccagttggagaaagaagtggtacgtgtctggttctgtaatagaagacaaaaagaaaaaagaatgactccgccaggggatcagcagccacacgaggtttattcgcacacggtgaaaacagatgcgtcctgccacgatctctgactggaggaagcaaggaggtggcccgctgcactgggagcagtgctgatacaattctctctttaccttcctttcagcattacattctttattattgctatctctctagcttgctagctcttcctttctttcacaggggtttctaacttcttatgacttatgt

SEQ ID NO: 1983 - DNA, 2011 bp, Rattus norvegicus
  Genbank Accession No. NM_017255
ggcacgaggcggcggcggcgcctggaggggaccagtgcggcggggagatgacggggacctaaagaggaacgaacaccgggagaggccgccaagtgcggcctgaggacaggcgcgcctgtcgactcagcgccaaacagggagagcccattacgtgactctgtcccgagggcctgggctcccagcccttgtactgcgcaaaactgggcggtgagagccggctgccggcgcgctgttgaactttgttttctctagagcgtggacctcggagccctccaggcagctgcttgccttgaaaaatgctggaggctgggcgggggcccaggcccgggaacctgttcttcctgtttcctgcctcagtcccagtagctggtccaggcctgtgcacatgcgagtgaagaactggaacggacgctgagcatccaagagcacctgctgcagcacctgctgtcacaccaagagcaggagctgatcgggtccagggcaatggcagcaggcctggactcctggaatagtaccatcaatggcacctgggagggggacgaactgggttacaaatgtcgcttcaacgaggacttcaagtatgtgctgctgcccgtgtcctatggcgtggtgtgcgtgctcgggctgtgcctgaacgtcgtggccctctacatcttcctgtgccgcctcaagacctggaacgcctccaccacctacatgtttcacctggcagtttctgactctctctacgcagcctccctgccgctgctggtttattactacgcccagggtgaccactggccatttagcacagtgctctgcaagctggtgcgtttccttttctacactaacctctactgcagcatcctcttcctcacctgcatcagcgtgcaccggtgcctgggggtcctgcgccctctgcactccctgagctggggccatgcccgctatgcccgccgagtggctgcggttgtgtgggtgctagtgctggcctgccaggcacccgtgctctactttgtcaccaccagcgtgagagggacccgaatcacctgccacgacacctcggcccgagagctctttagccattttgtggcttacagctctgtcatgctgggtctgctttttgctgtgcccttttccatcatcctggtctgttacgtgctcatggcccgacggctgctcaaaccggcttatgggaccacaggtctgcctcgggccaagcgcaagtctgtgcgcaccatcgccttagtactggccgtcttcgccctctgcttcctgcctttccacgtcacccgcaccctctattactccttccgatcacttgacctcagttgccacaccctcaacgccatcaacatggcgtataagatcacccggccactggccagcgccaacagttgccttgaccctgtgctctacttcctggcagggcagagactggtccgctttgcccgagatgccaagcccgccacagagcctacacccagcccacaggctcgtcgcaagctggggctgcacaggcctaacagaactgacactgtgaggaaagatttgtcgatcagcagtgatgactcaagaaggacagagtccacaccagctggaagtgagactaaggacattcgtctatagcagctcagtcaggtgtcagttcatgtaggggagagctgtaggggaccaaagcttgttcaaaggggctgatatcctctgatatgatatcaacggctctcatttggcagggactcaggatactcatcctgtggtcccaagagtgacaggaccccaaagtccccaatcatttgtatgtgtgagttggggaatcgtatctaaggcaacgccacctgactcccatgcaaacagctgccattcctgccaaggtacctaggccgagcttcagcctcttaaatccaagggagaagcaggcccagggagaacacagcagagtccagactagctacctggattagaagtagaatcgcggggttggggatttagctcagcggtagagcgccctgggttcagtccccagctccgg

SEQ ID NO: 1984 - DNA, 1464 bp, Rattus norvegicus
  Genbank Accession No. NM_017258
atgcatcccttctacactcgggccgccaccatgataggcgagatcgccgccgcggtgtccttcatctccaagttcctccgcaccaaggggctcacgagcgagcgacagctgcagactttcagccagagcctgcaggaactgctggcagagcattacaaacatcactggttcccagaaaagccgtgcaagggatcaggttaccgttgtattcgcatcaaccataagatggatcctctgattggacaggcagcccagcggattggactgagcagtcaagagttgttcaggcttctcccaagtgaactcacactctgggttgacccctacgaagtgtcctacaggattggagaggatggctccatctgtgtgctgtatgaagcctcaccagcgggaggtagctctcaaaacagcaccaacgtgcaaatggtagacagcagaatcagctgtaaggaggaacttctcttgggcagaacaagcccttccaaaaactacaatatgatgactgtatcaggttaagatatagtctatggatggatcatcttataatggatggatagatttgattttttgctttgggtgggctcctcttggggatggattatggaataaccatgtcacagctgtgaagatctggcacaagatagagtggtaataatttttttttttaaagtgacagtgccatagtttggacagtacctttaagtgatttaagtagcctgtgagtccaagtaaaggatcactttatttggtagggagtgaagtcgcagggtggtttcagtttctcccagaccttatacccaatttgtcacaccagtccctttaaggaaattctgtatttcaaagaaccctcttttgcagtcagtcaaccttgcaggggaatttgcactatttacacttgaaagttaccagtaacttttttttggcagctcaataggaaagctcaatgttctaagcatggtagtactggaaatattacacggagacttttacctagcacttaaaaatgtataaatgtacataaagacacttagtacgcatgacctgggggaaatggtcagaccttgtgtttttggctttgagagtagcaagtgaccggaatctgccatgacaacaggcttttaaaagacccttacaaagacactgtctcaactgtggttagcaccagccagctctctgtacattcgcttgtagttttctaagattgagtgagtaaacttcttatttttagaaagtggaggtctggtttgtaactttccttgtactcaattgggtaagagtctttttccacaaaccgccatctattttgtgaactttgttagtcatcttttatttggtaaattatgaactggtgtaaatttgtacagttcatgtatattgattgtggcaaagttgtacagatttctatattttggatgagaaatttttcttctctctataataaattgtttcttatcttggcatttt

SEQ ID NO: 1985 - DNA, 2519 bp, Rattus norvegicus
  Genbank Accession No. NM_017259
agagcccgtgaggcggccggaccatcatcgtcctgctaatacagctacttcctcaaccaccggtatgagccacgggaagagaaccgacatgctcccggagatcgccgccgccgtaggtttcctcaccagtctcctgaggactcggggctgcgtgagcgagcagagactcaaggttttcagtagggcgctccaggacgcactgaccgatcattacaaacaccactggtttccagaaaagccatccaagggctccggctatcgctgtatccgcatcaaccacaagatggaccccatcatcagcaaggtggccagccagatcggactcagccagccccagctgcaccagctcctgcccagcgagctgaccctgtgggtcgatccctacgaagtgtcctaccgcatcggggaagatggatccatctgcgtgctgtatgaggaggcgccggtggccacctcctacgggctcctcacctgcaagaaccagatgatgctgggcaggagcagtccatcgaagaactacgtgatgactgtctccagctagagaggagccgccccgccctggcactctactgttctcatgctgccctgacaacaggccaccgtatacctcaacctggggaactgtatttttaaagtgaagagctatttatacatgttatttttttttttaagaaaagaggaggaaaaaaaccaaaagtttttttttaaaaaaacaaaaaagaaaaaacaattcgttaacgggagctgcttggaagtggtctccccaggtgcctttggagagaactgttcttgattgagtctatgagccagtgtttgcctaggggagtgggttggggattggcctagccaaggtaaaaggggattcttggctgatcccccaggaggtggtggaagggagcaaggttagcaactgtgaacgagaggggtcagggtctgctctgggttaccgttcccgctgggatgcctgtattcctggtccctctcttactcaggggcattcaagcctggtctcaaataatactacattgcctaatcttctcttttgtttttctgctgagatcctgggcacacggaaaggcctctcctgtcccttccgtctgagcagagtttcttgaaactgtgtctcgtttctgatcctaccctcggggtcctgaagaggtggtttcccggcctagaatctatctaaacgtttttggagggtgggctataaggcagatataatggaggggaaccgcacaaaccctttgctttgctctgtgctgctttgtatggatggatggttaataacttagggatgatttgcaatggaattttgggacccaaagagtatccaatgggggtgggtgttttggacctaagccctccttttgggaaccacgtgacagtctgaatgctgctaccattattcctttgagaggtggctcaaagctccagggaactccaggtcctttcttactgccttctcttcaagagcaacctcccccatttcttttccctctttcctgcggttgggtcctggagggccccatttcctaggacaagagttctcaatcactgtgcaatagtcccaggaagctctggaactgggcctcccagcccctcctgattcctggtgggttttaggaccccgccttccccgttcttctgactggctggtgggccttgaggagatctccctcggccgcagggagggcacctgtgcactgcaggactacctggtactcctgtggggctgccacggagagccaaaccttaggcatagctttgtctcctcggtgctcagagcacctgcagggggaggttgcccccctcagtaaaaatccaaatttatttgtagatgtgtgcaatatttactgttctgggttggagaaaatcgggaaacactgggaagaagtggccttccttcaggttcagtgacactgatgagggcttctcagaaggcctcgagtctctcaaaccaaaggacagagctagagccagccagtcacccttagtgaggatccccttccccatgtctctccactgccgtggcatcccatgtcctggatttctcaattcctcagtttctactcaaaggtgctacttaccaaacactctgcccgtcccgctctccccagcttcgcacagccgtcccaggtggcttcgtctctcctgctttaaagttaactttgggcccacagacccgagagctgtgggttgaagcaaagctgtgaatcgctccagatggtccctgtgttctgtccacacacaggtccccgcctttttagaagcagcctcctggtctcatgcttaaatctgttcctcactgcccgtgttcactttagaaatggcagaaccacagagctggactgttgagcaggcctgtctctctcattaaatagaaataagtaagtttgtaagctattccgacagaagagacaaaggttactgattgtacaatagcgcttttatatggaagactgtacagctttatggacaaatgtaaaacttttttgtttttaataaaaatgtagcagacc

SEQ ID NO: 1986 - DNA, 540 bp, Rattus norvegicus
  Genbank Accession No. NM_017260
actagttgtctctggggagcctgagcaagcatggatcaagaggctgtgggcaatgttgtgctcctggccatcgtcaccctcatcagcgtggtccagaacgcattcttcgcccacaaggtggagcttgaaagcaaggcgcaaagcgggagaagcttccagaggacggggactcttgccttcgagcgggtctacactgccaaccagaactgcgtagatgcgtaccccactttccttgtggtactctggactgcaggactactttgcagccaagtccccgccgccttcgctgggctgatgtatctgttcgtgaggcaaaagtactttgtcggctatctgggagagagaactcagagcacccctggctacatattcggcaagcggatcatcctattcttgttcctcatgtcccttgccggcatcctcaaccattacctcatcttcttcttcggaagcgacttcgagaactacattagaactataaccacgacgatctccccgctgcttctcatcccctgatggctggataccggagtaggacga

SEQ ID NO: 1987 - DNA, 3275 bp, Rattus norvegicus
  Genbank Accession No. NM_017268
cccagggtccgatcgcgtttggtgcctgaaggaggaaccggtgacagacctggagactacagttctctgtccttcacacagctctttcaccatgcctgggtcacttcctttgaatgcagaggcttgctggccaaaagatgtgggaatcgttgcccttgaaatctactttccttctcagtatgttgatcaagctgagttggaaaaatacgatggtgtagatgctggaaagtataccattggcctgggccaggccaggatgggcttctgcacggatcgcgaagacatcaactctctctgcctgactgtggttcagaaactgatggagagaaatagcctttcctatgactgcattgggcggctggaagtcgggacagagacaatcatcgacaaatcaaaatccgtgaagtctaatttgatgcagctgtttgaggagtctgggaatacagatatagaaggaatagatacaactaatgcatgctatgggggcacagccgcagtcttcaatgctgtgaactggatcgaatccagctcttgggatggacgatacgctttggtagttgcaggagacatcgctatatatgcctcaggaaacgccaggcctacaggtggagttggagctgtggctctgctaattgggccaaatgctcctgtaatttttgaccgagggcttcgtgggacacacatgcagcatgcctacgacttttacaagcctgacatgctctctgaataccctgtggtagatggaaaactctccatacagtgctacctcagcgcattggaccgctgctattctgtctaccgcaaaaagatccgggcccagtggcagaaagagggaaaggataaagattttaccctgaatgattttggcttcatgatctttcactcgccatactgtaaactggtgcagaaatctctagctaggatgttcctgaatgactttcttaacgatcaaaacagagacaaaaacagtatttacagtgggctggaagcctttggggatgtgaaattagaagatacttacttcgacagagatgtggaaaaggcatttatgaaggctagtgctgagctattcaaccagaaaacaaaggcatctttgcttgtatcgaatcaaaatggaaacatgtacacatcctctgtatacggttcccttgcttctgttctggcacagtactcacctcaacagttggccgggaagaggattggagtgttctcttacggttctggcttggctgccacactctactcccttaaagtcacacaagatgccacaccaggatctgctcttgacaaaataacagcaagtttatgtgaccttaagtcaaggcttgactcaagaacgtgtgtggcaccagacgtctttgctgaaaacatgaagctcagagaggacacacatcacttagccaactatattccccagtgttcaatagattcactcttcgaaggaacatggtatctagtcagagtggatgaaaagcacagaagaacttacgcccggcgtccctccacaaatgaccacagtttggatgaaggagtgggacttgtgcattcaaacacagctacagagcatattccaagcccggctaagaaagtgccaagacttcctgcgacctcgggcgaacctgagtcggctgtcatcagtaacggggagcactgagagccgtggccttcacagaggctcggggctggatggggtatgggaaacgttagaggaatggatgtcttgggacaattttacagattacgtgttgcttaaaaatgtaatgtaactgacacagagcccagaaaactgttgtgtttttggagaagtctcgctgagctcctaacacacttcctgctgtgggctggccaatggtgaatgtactgcgatggtgttaagggctctgcagaacgtcatacctcgctgcatgtttacacgcatgcgggttaggcttcaaactcggtctgaactgagtgcttctgactgcaaaggcagaggtactgctgtccagtttaaaaaattgttttttttttttttaatgtgtaagaatttttatacttaaataaaaaaaagtacctgtagcttttgggggaaaaaaaaaaacctttttctaggttggggattgtggaatttaaatgttacacataaactctgcttaatggcaaggcaaacatttatctttttcgaagatttataaatcctgaagagaaaaaaagagggtatggttctaggatctggatgaaccatcagtgagaaaggttagtcataatcaagtgagcagaaggatgctggcgttgagcaggcctctgtcacagcaaccagggctctgtgggcacagctgagggaactttctggccaggtgcccgtgactgctgctcagctgcactgagatgcagtggagctgctgcacggaagcttgctgtggtgctgaacgccttacctgcggataaagtgtaaagtaggagggatgggcagggcactattaggttacagtgttacagacccaggttatagacttgacagctcaaactcaccagacacctttttccctttgtggtttgtgtattttttgtgttttgtttgtttttttttatattgttcaatttaaaaaatttagaaaattttaaccttacgttttcacatagtgtgattagccaaaaggaatttcacttcaagatctagaaatagaattcataacattttttcctaaactttgacttttaaaacaacgaaaattaccacatgagatgaacaagaaaattcattagaaagttctctgggtgatttttggtgctgaactgacatgagcctcatagactgtaaaacagaggtagttgaaactaatgtacagaactacattttttaattttatttgcatttaattctgtgaagtttcagttatctaaaataaacacataaacgtgtaatgtttcagattgcaaggtgagatgtaatgtagcatttgtaagatattcttgtcaatattaactggtaggattttgatttgtacagttttaattggttaaaatgatctcattttaacatccactgctatagatgaatgatgtaagctcagatttaatgaatggtggggaaatggtgcatgtaattttttcgcaagtatcgagagttctgtatgttttgaaaagaataatttaacgtttgggttgccaggaagggggctttcccagagtccattgccaggcgttgggcaagcctcgcaatgttggcacggagcgttaaccacaccttactaatagcaaggggaataactttgaaataaagttttagacaaata

SEQ ID NO: 1988 - DNA, 2024 bp, Rattus norvegicus
  Genbank Accession No. NM_017272
caatttgctgagcctgtcacctttgttccaggagccaaaccagcaatgtcttcccctgcacagcctgcagttcctgccccactggccaacttgaagattcaacacaccaagatctttataaacaatgaatggcacaactcattgaatggcaagaaatttcctgtcattaaccctgcaactgaagaggtcatctgccatgtggaagaaggggacaaggcagatgttgacaaagctgtgaaggctgcaagacaggctttccagattggctccccctggcgcaccatggatgcttcagagagaggatgcctgctgaacaagctggctgacttaatggagagagatcgcgtgctgctggctacaatggaatcaatgaatgctggaaaaatctttactcatgcataccttttggatacagaggtcagcataaaagccttaaagtactttgcaggctgggcagacaagattcatggccaaacaattccaagtgatggagatgttttcacttatacaagacgtgaacctattggggtgtgtggccaaatcattccttggaatggtccgttgattttattcatttggaagataggcgctgcccttagctgtgggaacactgtgattgtgaagccagcagagcaaactcctctcacagctctttacatggcatctttaataaaagaggcagggtttcctcctggtgtggtgaacgttgtccctggttatggatcaactgcaggggcagccatctcttctcacatggacatagacaaggtgtctttcacaggatcaacagaggttggcaaattaatcaaagaagctgcagggaaaagcaatctgaagagggtcaccctggagcttgggggaaagagcccttgcattgtgtttgcagatgctgacttggatagtgctgttgagtttgcacaccaaggagtattcttccaccagggtcagatttgtgtcgcagcatccagactttttgttgaggagtccatttacgatgaatttgttaggaggagtgtggagcgggctaagaaatacgttctaggaaatcctctggactcaggaataagtcaaggtcctcagattgacaaggagcaacatgctaaaatccttgatctcattgagagtgggaagaaagaaggcgccaaactggagtgtggtggaggacgctgggggaacaaaggcttctttgtccagcctacagtcttctccaatgtgaccgatgagatgcgcattgccaaagaggagatatttggaccagtgcaacaaatcatgaagtttaagtccatagatgaggtgatcaagagagccaacaatactccctatggtctagcagcaggagtcttcacaaaagacctggacagggccatcactgtgtcttctgctctgcaggccgggacagtgtgggtgaattgttatttgactctctctgtccagtgcccatttggtgggttcaagatgtctggaaatgggcgagaaatgggtgaacagggtgtttatgaatacactgagctcaagacagtcgcaatgaaaatatctcagaagaactcctaaagaagccagcagagtgacgagaaactctcagcagtagctacatgtctcctacaatcaccagcagagggttgttttattacagggtcttctgttgatttcttaaacataaggaatccatcagcattactgtaactcatagaaaatgtatagtttaattcttctaatacatgaccctaatacatacccaagaagaaagggatacatttaggtacatgctctttgtaacccagtcatgaaaaagtgcttttcattgtagctacttgtctacagccctcatttgatgtgatttaaactctgtttctcggtgacttcttgccactactcaccatgcacaactgaaaagtcagccactgttcttggagttattgttctgagtattgtgaaatatttttagaatgacatacctgcttgtcaaatgaaatgcttagctgtaattagagtgcaaagtttaataaaggcaaaatctcacatga

SEQ ID NO: 1989 - DNA, 2646 bp, Rattus norvegicus
  Genbank Accession No. NM_017274
cacgaataagcctctggaggagctgctgaatcacccccgccccaggctgtcttctgaagctgtctggggatagctttgctaatcaactgactggaaataattccagacaccacatcaaggatacagctcatgttttgtttgggacttccacgttgagtcatggaggagtcttcagtgacaattggcacaatagacgtttcttatctgcccaattcatcagaatacagccttggccgatgtaaacacacgaatgaggactgggttgactgtggcttcaaacctaccttcttcagatccgcaacgctgaaatggaaggagagcctcatgagccggaagaggcccttcgtgggaaggtgttgctattcatgcacgcctcagagctgggaaaggtttttcaaccccagtatcccatctctgggtttgcggaatgttatttatatcaatgaaactcacacaaggcaccgaggatggctggcaagacggctttcttacatcctttttgttcaagagcgcgatgtccacaagggcatgtttgccaccagtatcactgacaatgtactgaatagcagcagagtccaagaggcaattgctgaagtggctgcagaattgaacccggatggatctgcccagcagcagtccaaagccatccagaaagtgaaaaggaaagccaggaagatcctccaggaaatggttgctacagtctcccccgggatgatcaggctgactggctgggtgttactaaagctcttcaacagcttcttctggaacattcagattcacaagggtcaacttgagatggtgaaagctgcaactgagacgaatctgccgctcttgtttctgccggtgcacagatcccacatcgactacctgctgctcaccttcatcctcttctgccacaacatcaaagctccatacatcgcctcgggcaacaacctcaacatccccatcttcagtaccttgattcacaagcttgggggctttttcataagacggaggcttgacgaaactccagatggacgcaaagacattctgtacagagcgttgctccatgggcatatagttgaactcctccgacagcagcagttcctggagatcttcctggaaggcacccgctcccgcagtggcaagacctcctgtgcccgggccgggctcctgtcagtggtagtggatactctgtcatccaacaccatccctgacatcctggtcatccctgtgggcatctcgtatgatcggataatcgaaggtcactacaatggtgaacagttgggcaagcccaagaagaatgaaagtctctggagtgtggcaagaggcgttatcagaatgctgcggaaaaactacggctatgtccgagtggactttgcacagccattttctttgaaggaatatttagaaggccaaagtcagaaacctgtatctgctcccctctctttggagcaagcactgttaccagcaatccttccttcaagacctgatgctgctgctgccgaacatgaagacatgtccagtaatgagtcgagaaacgcggcagacgaagccttccgaaggaggctgatcgcaaacctggcggagcacattctcttcaccgccagcaagtcctgcgctatcatgtccacccacattgtggcctgcctgctcctctacagacacaggcagggaatccacctctccacgctggtggaagacttctttgtgatgaaggaggaagtcctagctcgggattttgacctgggcttctccgggaattcagaagatgtagtcatgcatgctattcagcttctggggaactgtgtcacaatcacccacactagcaggaaggatgaattctttattactcccagcacaactgtcccgtccgtctttgaactcaacttctacagcaatggggtacttcatgtctttatcatggaagccatcatagcttgcagcatttatgcagtccagaataagaggggttccggagggtctgccggaggccttggcaacctgatcagccaggagcagctggtgcggaaggccgccagcctgtgctaccttctctctaatgaaggtaccatttctctgccctgccagacattttaccaggtttgtcaagagacagtaggaaagttcatccagtacggaattctcacagtggcagagcaagatgaccaggaagatgtcagtcctggccttgcagagcagcagtggaacaagaagcttccggagcctctgaactggagaagtgacgaagaagatgaggacagtgactttggtgaggagcagcgtgattgctacctgaaggtgagccaggccaaggagcaccagcaattcatcacctttctgcagaggcttctggggcccctgctagaagcctacagctctgctgccatctttgtccacaccttccgcggcccagtcccggagtctgagtacctgcagaagctgcacaggtaccttctcaccaggacggagaggaacgtcgcggtgtacgctgagagtgccacatactgtcttgtgaagaatgctgtgaaaatgtttaaggacatcggggttttcaaagagaccaagcagaagcgagcgtctgtcttagaactgagcaccactttcctacctcagggcagccggcagaagctcctggaatacattctgagcttcgtggtgctgtag

SEQ ID NO: 1990 - DNA, 3679 bp, Rattus norvegicus
  Genbank Accession No. NM_017277
tgacatggtaaagagtctggccacagataaaggaccgaaatgactgactcaaaatacttcacaacaaccaagaaaggggagatcttcgagttgaaggcagagcttaacagtgacaagaaggagaagaagaaggaggcagtaaagaaagtgattgcatcaatgaccgtgggcaaagatgtcagtgctctcttccctgatgtggtgaactgcatgcagacagacaacctggagctaaagaagctggtgtacctgtacttgatgaactatgccaagagtcagcctgacatggccattatggctgtcaacaccttcgtgaaggactgtgaggaccccaacccccttatccgggccctggctgtgaggactatgggctgcatccgagttgacaagatcacagagtacttgtgtgaaccactccggaaatgcctgaaggatgaagacccatatgtgcgcaagacagcagctgtgtgtgtagccaagctccacgacatcaacgcccagctggtagaggaccagggtttcctggacacactcaaagacctcatctctgactctaaccccatggtggtagcaaatcgagtggctgccctgtcagagatcgctgagtctcaccccagtagcaacctgcttgacttgaaggcacagtctatcaacaagctgctgacggcccttaatgagtgcaccgagtgggcccagatcttcattctggactgtctgggcaactacatgcccaaggatgaccgtgaggcccagagcatctgcgagcgggtcactcctaggctttcccatgccaactctgctgtggtgctgtccgcagtgaaggtcctgatgaagttcatggagatgctgtctaaggacctggactactatgccacactactcaagaagctggcccctcccctggtcaccctgctgtcagcagagccagagccgcagtatgtgcctctgcgcaatattaacctcattgtacagaaaaggccagagattttgaagcatgaaatgaaggttttctttgtgaagtacaatgaccccatctatgtgaagctggagaaactggacattatgatccgcctggcctcccaggccaacattgcccaggttttggcagaactcaaagagtacgcgacagaagtagatgtggattttgtacggaaggcagtgcgtgccattggccgctgtgccatcaaggtggagcaatctgcagagcgctgtgtgagcacattgcttgatctcatccagaccaaggtcaactatgtggtccaggaagccattgtggtcattaaagacatcttccgcaagtaccccaacaagtacgagagtgtgatagccacactgtgtgagaatctggactcgctggatgagcctgaggctcgcgctgctatgatctggatagtgggcgagtatgctgagcggattgacaatgcggacgagctgcttgagagcttcctcgacggcttccatgacgagagcacccaggtccagctacagctgctgacagccattgtgaagctcttcctgaagaagccaacagagacgcaggagctggtgcagcaggtcctcagtttggccactcaggactcggacaatccagaccttcgggaccgtggctacatctactggcgcctgctctccacggaccctgtagctgccaaagaggtggtactggctgagaagcccctcatctcagaagagacagaccttattgagcccacactgctggatgaactcatctgctacattggcacactggcctctgtctaccacaagccacccaatgcctttgtggagggcggccggggagtggtgcacaagagtctgccacctcgcactgcctcgagcgaaagcacagagagccctgaggcagcccctgccggagcacctgctagtgaccagcctgatgtcattcctgcccagggtgacctgttaggtgacctcctcaacctggaccttgggcccccagtgagtggcccacccttggctgcctcctcagtgcagatgggagctgtggatcttcttggtggtggcctcgacagcctgatgggggatgagcctgaagggattggagacagcaactttggggcacctccagcatcagtggcggcggcagcaccagccagacttggagcacccgtcagcagtggcttaagtgacctctttgacctgaccagtggagtgggcaccctctcagggtcctatgtcgctcccaaagcagtttggctccctgccatgaaggccaaggggctggaaatctctggcaccttcacccggcaggttggctccatctccatggatctgcagctgactaacaaggccctgcaggtcatgacagatttcgctatccagtttaatcggaacagctttggcttggcccccgctgcgccactccaagtgcacgccccactgagccccaaccagacggtggagatctccctgcctcttaacacggtgggctcagtcatgaagatggagcctctgaacaatcttcaggtggctgtgaagaacaacattgacgtcttctacttcagcactttgtacccactgcatgtcctcttcgtggaggacgggaagatggaccggcagatgttcctggccacatggaaggacattcccaacgagaatgaagcccagttccagatcagagactgcccgctgaacacagaggctgcaagcagcaagctgcaaagcagtaacattttcactgtcgccaagaggactgtggagggccaggacatgctctaccaatctctgaagttgaccaatggcatctgggtgctggcagagctgcggatccagccaggcaaccccagtttcacgctgtccctgaagtgtcgagccccagaggtgtcccagcatgatatccaggcctacgagaccatcctcaagaactgaagtccctctcgctccaccccagccttctccttctgccagcccagccatggaaccctgtggtggcagcacctcctcctttctttggggagaagccagtgggctcctgacccacccaggaggcctcccctgatcctaactgagggcctggagcagggccaggtctcctagagtgaaatctccgtgcatctccagtggctgcttttttctattgctgttgatgtgggatcaaaggaagtggatccagcacagcatcagaagctggacgggggccacagggtgctcttccttccttctgctctcctggggtgaacatggaaccctcctggggtcccagcccataatccctgccctgtctcctcagtgagcctgtctgggtagagtcctctgggtgccaatattactgtttgggactctgagagctggaggtggtgatggacagacatgagcccaggggagcaacctgggctggcactgtctgccccatataacaccagttggtgctctgtgaccacctgcatggcccagagcccgatctaggattctgttcccttaggccctggaggatggtcactgcctaccaaacattcctcggtgtcctctctgtgagtccagggctctcagaccagaagtggggtgaaaggtggggcaaggggcagtgggaccgcttctagtgtgagctcctgacccactggctgccctggctccccagtctgtgtgtgacagtgacaggttgatcgtcgctactgtttgataataaagagttctgcttttggcaaaaaaaaaaaaaaaa

SEQ ID NO: 1991 - DNA, 1174 bp, Rattus norvegicus
  Genbank Accession No. NM_017278
ccgcagccttctttgacgatcaccgaaccgtagttgaggccgtgttcctgtgtccgctgctgtgtctggttgtaacctcgccggagctatgtttcgcaaccagtatgacaacgatgtcactgtttggagccctcagggcaggattcatcaaatcgaatatgcaatggaagctgtaaagcaaggctcagcgacagtcggcctgaagtcgaagacacatgcagtgctggtcgcgctgaagagagcacagtcagagcttgccgctcaccagaagaaaattctccacgttgacaaccatattggtatctcaattgcgggtctaactgctgatgccagactgttatgtaactttatgcgccaggagtgtttggattccagatttgtatttgacagaccacttcccgtatctcgccttgtgtctctaattggaagcaagacccagataccaacacagcgatatggccggagaccgtatggtgttgggctgctcattgctggttatgatgacatgggccctcacgttttccaaacctgcccatctgctaactattttgactgcagagctatgtccatcggagcccgttcccagtcagctcgcacttacctggagagacacatgtctgaatttatgcagtgcaatttggatgaactggttaagcatggtcttcgcgccttaagagaaacactccctgcagaacaggacctgaccacaaagaatgtttccattgggattgttggtaaagacttggaatttactatctatgatgatgatgatgtgtctccattcctggatggtcttgaagaaagaccacagagaaaagcacagccttcacaggctgctgatgaacctgcagaaaaagctgatgaaccaatggaacattaagtgataaaggttatgaggacatgaggatgcaggggcatacactggtgacaataatctgtattttaaaccaacagctgtaatgtattgggtggtatgttttagaaatcagtccaactgtgagttttctctaagcagcttcacagaaaccatataatggggtgcattttctttgaaagggtctacataatcattttctaggacgtataggtatctatatcaatgtttttatatgaagaaaataagtgtctttgcagttttaaagacaactgtgaaataaaattgtttcaccacctg

SEQ ID NO: 1992 - DNA, 932 bp, Rattus norvegicus
  Genbank Accession No. NM_017283
gtgtgtgtgcgctacggggtgwagactgtgtctgaaatagcgggaacgccatgtcccgtggttccagcgccggttttgaccggcacattactattttctctcccgagggccgactctaccaagtagaatatgcttttaaggctattaaccagggtggacttacatctgtagctgtcagaggaaaggactgcgcagttattgtcacacagaagaaagtacctgacaaactactggattccagcaccgtgactcacttattcaagataacggaaaacattggctgtgtgatgacaggaatgacagctgacagcagatcccaggtacagagggcacgctatgaagcagctaactggaaatacaaatatggctatgagattcctgtggacatgctgtgtaaaagaattgctgatatttctcaagtctacacacagaatgctgaaatgaggccacttggttgttgtatgattttaattggtatagatgaagagcaaggccctcaagtgtacaagtgtgatcctgcaggctactactgtggctttaaagccaccgcagcaggagtgaagcagacagagtcaaccagcttcctcgaaaaaaaagtgaagaagaaatttgattggacatttgaacagacagtggaaactgcaatcacatgcctgtctactgttctgtcgattgatttcaaaccttcagaaatcgaagttggagtagttacagttgaaaatcctaaattcaggattcttacagaagcagagattgacgctcaccttgtggctctagcagagagagactgaacactcttatcagcttaccagatccatgatgccatgtgcctatgtgtttagtaacaacaaaccgacatcttagaggccctggattgaagatggaaactctcccactcctcctgccactgactggttaggactctgtataaa

SEQ ID NO: 1993 - DNA, 1490 bp, Rattus norvegicus
  Genbank Accession No. NM_017288
cgcagcctggatgcgccctgtggcgcacgcacgcagcatcccgagcctcccgccgcgcgcgggatgcctgctctccgggccccggggcttggccccggcggtaaccggagcgggggggcgcgcccccccagcagcagctgcggcgcccgcgcccgggccagtcgccgccggggcccatctcctgtcgccgcgctctgcgacccaccgccttgcgcggccatggggacgctgctggctctcgtggtgggcgcggtgctggtatcctcagcctgggggggctgcgtggaggtggattctgagaccgaggcagtgtatgggatgaccttcaaaatcctgtgtatctcctgtaagcgtcgtagtgagaccaccgccgagaccttcacggagtggaccttccgccagaagggcacagaggaatttgtcaagatcctacgctatgagaatgaggtgctgcagctggaggaagatgagcgctttgagggccgtgtggtgtggaacggtagtcggggcaccaaggacctgcaggacctgtccatcttcatcaccaatgtcacctacaaccactctggcgactacgaatgtcacgtctaccgtctcctcttctttgataattacgagcacaacaccagcgtcgtcaagaagatccacctggaggtggtggacaaggccaacagagatatggcatccatcgtgtcagagatcatgatgtacgtgctcattgtggtgttaaccatatggctcgtggcggagatggtgtactgctacaagaagattgctgctgccacggaagctgctgcacaagagaatgcctcggaatacctggccattacttccgagagcaaagagaactgtacaggcgtccaggtggctgaatagcgctggctctgggctccgcctcaaggaagagccagcctacgggtaccctccagccctgcagtggggatcagcccctggtgggtaccctcccctggcagtggggatcagcccatcggtctccccagcctcacagttctgcagtggagccaccagggtgggagcgggcagggactgatcccacctcacccaccgcctcccacctaccctcccaccgccatgcatgatgggtgaagcaatatggccgccccaccctgcttttgctgcctgtttgggggagggggcggtgaggcgagggggcaggccccgcccccttctttttgctgatttgcacataggccacttccacacgcactgccaggccagccggcccacccctgcttgatggggtgaagaggggtcgggacagggacagtagtgggcagggggttctgggcctcatctcccctccgcttcctccggctggacctggggttcccttcctgtgacacctcctagccctggcccacccgccctctctcaccagccttcaattgtggtctcttgggaaggcctcttcggcctcctatctttacagaagtagtttttgttcatgaaataaagattcttggactcga

SEQ ID NO: 1994 - DNA, 5648 bp, Rattus norvegicus
  Genbank Accession No. NM_017290
cggagccgtccccgacgccacctcccgtctcctccgccgcagtttcctccgccgctgtcgggggtgcagagctgaggggctcgggcagcgcgccgcgcagctcctctccagtcgcccgcctcgccgtcctccccaccgagggctcgcccgggcgcccctcctcagccgcgccgggtctcctcgcgcagcgccgcggcctgcgctacctgcggccggctggcaacagaggcaacgcacactcgcggcggggcgggaggctcgcagcccctcgggcgggctcggcgaggcccggccgcgtgcggcggtttctgggggagggggctcgggtgattcagcgcccggtcaggcggaagcggccgccgccgcggaggaggaggagaaagaggaggggacagctgtccgcgcccgggcgcccgcggtggcacgagcccgcggcccgagtgcgaggcggaggcgaggaggccgcggggacgcgaggcgaggccggccggggcccccgcagccatggagaacgctcacacaaagaccgtggaggaggtgctgggccacttcggcgtcaacgagagcacggggctgagcctggagcaggtcaagaagctcaaggagagatggggctccaacgaattgccggctgaagaaggaaagaccttgctggaacttgtgatcgagcagtttgaagacttactagttagaattttattgctggcagcatgtatatctttcgttttggcttggttcgaagaaggtgaagaaacgattacagcctttgtagaaccttttgtaattctgcttatattggtagccaatgcaattgtgggtgtatggcaggagagaaacgctgaaaatgcaatagaagctcttaaggagtatgaacctgaaatgggcaaggtgtatcgacaggacagaaagagtgtgcagcggattaaagcgaaagatatagttcctggggatatagtggaaattgctgttggtgacaaagttccggctgacattagattgacatccatcaagtctacaactctgagagttgaccagtcgattcttacaggtgaatctgtctcggtcatcaagcatactgaccccgtccctgacccacgagctgttaatcaagacaaaaagaacatgctcttttctggcacaaacatcgctgctggcaaagctatgggagtggtggtggcgactggagtcaatactgagatcggcaagatccgggatgaaatggttgcaacagaacaggagagaacacccctacagcagaagctggacgagtttggggaacagctttccaaagttatctccctcatttgcattgcagtctggatcatcaacatcgggcatttcaatgacccagttcatggtggctcttggatcagaggtgccatctactactttaagattgcagtggccctggctgttgctgccatccctgagggtctgcctgctgtcatcaccacctgcttggctcttggaactcgaaggatggcaaagaaaaatgctattgttcgaagtctgccttctgtggaaacccttggttgtacttctgttatctgctcagacaagaccggcacacttaccacaaaccagatgtccgtctgcaggatgttcattctggacaaagtagaaggtgatacttgttcccttaatgagtttaccataactggatcaacctatgcacccattggagaagtgcaaaaagatgacaagccagtgaaatgccatcagtatgacgggcttgtagagttagcaacgatctgtgctctgtgtaatgactctgctttggattacaatgaggcgaagggtgtgtatgaaaaagttggagaagccacagagactgctctcacgtgcctggtagagaagatgaatgtattcgacacggagctgaagggactttctaaaatagaacgcgccaacgcctgcaactcggtcataaaacagcttatgaagaaggaattcacgctagagttttcacgtgatagaaaatcaatgtccgtctactgtacaccaaacaaaccgagccggacgtccatgagcaagatgtttgtgaagggtgctccagaaggtgtcatcgacaggtgcacccacatccgagttggaagtaccaaggtccccatgacgcctggtgttaaacagaagattatgtctgtcattcgggagtggggcagtggcagcgacacactgcggtgcctggctctggccactcatgacaacccgctgaggagagaggagatgcacctggaagattctgcgaacttcatcaaatatgagaccaatctgactttcgttggctgtgtgggcatgctggaccctcccaggattgaagtggcctcttctgtgaagctgtgccggcaagcgggcatccgagtcatcatgatcactggggataacaaaggcactgctgtggccatctgtcgccgcattggcatctttgggcaggatgaggatgtgacatcaaaggcttttacagggcgagaatttgatgaattaagcccctcagcccagagagacgcctgcttaaatgcccgttgttttgctcgagttgaaccttcccacaagtctaagatcgttgagttcctgcagtcctttgatgagatcacagctatgactggtgatggtgtgaacgacgcgcccgctctgaagaagtcggaaatcgggattgccatgggctcagggactgcagtggctaagacggcctctgagatggtgctggccgacgacaacttctccaccatcgtggccgctgttgaggaggggcgcgccatctacaacaacatgaagcagttcatccgctacctcatctcctccaacgtgggggaggtggtctgtatcttcctgacggcagcccttgggtttcctgaggctttgattcctgtccagttactctgggtcaatctggtgacggatggtctgcctgccactgcgctggggttcaatcctccagatctggacatcatgaacaaacccccacggaacccaaaagaaccgctgatcagcgggtggctctttttccgttacctggctattggctgttatgttggcgctgccaccgtgggtgctgctgcgtggtggttcatcgctgctgacggtggtccgagagtctccttctaccagctgagtcatttcctgcagtgtaaggaggacaacccagacttcgaaggagtggattgtgcaatctttgagtccccgtatccgatgacaatggcactttctgttctagtcaccatagagatgtgcaatgccctcaacagcttgtctgaaaaccagtccctgctgaggatgcccccctgggagaacatctggctcgtgggctccatctgcttgtccatgtcccttcacttcttgatcctctacgtggaacctttgccactcattttccagatcacaccgctgaatctgacccagtggctgatggtgctgaaaatctccctgcctgtgatcctcatggacgagacgctcaagtttgtggcccgaaactacctggagcctggtaaagagtgtgcgcagcctgccaccaaaccctcctgctccctgtcggcatgcaccgacggcatttcctggccctttgtgctgctcattatgcccctggtggtctgggtctacagcacagacactaactttagtgatatgttctggtcttgactgacagcgctacatgcagaagatgtttaacttaatcaattaattttttattgtttaaagcaactgtctatttctgctgaattttcacatgaacatattggctggtgaaggaggtttcatatctagattttgttttgctttttctgactccagtgggacaagattttccttttttttatacacataattaaagtgtccattgacatgtacagagaactaacactattttatgcagatatttttttgtagatgaaaaaagcatgtacagtgttctgtttcatactcatacttgtacaaagatcgttgagccagcagacattgtcagcaagttaattggcagcagacttaggaaatgaatgtgtgtggtttttaaaagaaaaaaaactaaatagcatgtattgtgtcttttgcatgattctctggatttaatttggtatcacagtctaatttttattcataagccaatttttctgcactgagcagagtcctgctacctcagtcagtatttttggtttgccactccctgcaccctcagcctctgtcacccccagcccaccctggcccgctcggctgcttctgtaggtctgatggttctgtttacatctgtcttcacgaggtttgcctgtctcgcttgtgcagaaaacattgctccagatccaatcgactgggtttctgtcccttcgcctagtttttaaggttatttatttaaatgtctaatgtattttattgtaacagacattgttttgccaacattgcctattcagtggcacttcacaatctagtttaaaagaaaaataaaacattttaaatggacagaggaaaataactgtcttgttcttaatggccttgaactacccatgatcagttcaaattcctgagcttctcagctcggagccttagtttcctgttcctgagaagaacgtgtactgctgcacagtagggattatctataatgtacaggcacgatcgtcatgtgacaaacatttactcaagtttctgctggcctggtgtatgtaggctggtgtaagggcaagtgtgtgtgtgtatgtgtgtgtgtgttctgtaaaatctgtaaatagcacatgaccaaatgaactgtatagaaatatttttatttgaatatggcactaaccaccaccaccatgactgaccggacgtttgcgcatgttcaaggtcagtcttaacggcagtgtgagtcattaacagtcctaactgtggtgttttcctccaatgccttccaacatccatcaactaaccaatactggagtaaccgcttcctaaacattgcagaaatgtaagggtgttcgggtgcgtgcatgtgcgttgttagcaacacatcttccagccctctgcatgactgagcttggggaaagagaaatagaacagcccccagctcactgtgtgatgtggaggaaatgtgtattacaagtggggttttagctgttgagtcaaaataataacaagtgtacaatttagcataaggaatcggagagcctctccagagaagtcggtttctttgctgcaagaagaatgaggttctgaacccttatccaagaacagaagccatcagccaagtctccacatttctctgcaaaatgttgtagcctctataactgtatgatagtgtaatgcatgccttcagttgtaagtggccagatcgcgctacagtgacattgaaacctgctctctaattggccctgtacagtttgcttatttataaattcatttaaaacactacagctgttgaatggttacaacctaggcctccggtcctaacttcagttgttctcctcggtgtgcagccagctgttccacactgtattattgtaacttatttagtgaagtcagaagcagtagacagatgttggtgcaatacaagtattgtgtgcatttatcgtaataaagtgctccgcgtcggttcagttcctcacagcttctcacagtgcatgtctgactgtagtctgtaaatagaggtcagtgtccgtgctgctaacaggtatcgatcgcacaga

SEQ ID NO: 1995 - DNA, 3156 bp, Rattus norvegicus
  Genbank Accession No. NM_017297
gtttacacgcctctgctagctggacctgcgacaccagagtggctcagggcggctgtcggtacgtaggcaatgcctgaggctatggaatcccctggagagccctgagagccacacgcaccgccttgaagggatcgccagaagttagccccaagggttcagagaagctctctgctctacgactatggccggtgattctaggaatgctatgaatcaagacatggagataggagtcacctcccaggaccacaagaagatccccaaacaggctcgggattacatccccattgccacagaccgcactcgcctgctgccggaaggcaagaagccacgccagcgctacatggagaagaccggcaagtgtaacgtgcaccatggcaatgttcaggaaacctaccgctacctaagtgacctcttcaccaccctggtggacctcaaatggcgcttcaaccttctggtcttcaccatggtctacaccattacttggctattctttggcttcatctggtggctcattgcttatgtccgaggtgatctggaccacgtgggtgaccaagagtggatcccttgtgttgaaaaccttagtggctttgtgtctgctttcctgttctccattgagacagaaacaaccattgggtatggcttcagagtcattacagagaagtgtccagaggggatcattctccttctagtgcaggccatcctgggctctattgttaatgccttcatggtgggttgcatgtttgtaaagatcagccagccaaagaagagagcagagaccctcatgttctccaacaatgctgtcatctccatgcgggatgagaagctgtgcctcatgttccgggttggggacctccgaaactcccatatcgtggaggcctccatccgcgccaagcttatcaagtcccggcagaccaaagaaggggaattcatccccttgaaccagaccgacattaacgtgggctttgacactggtgacgaccgcctcttcctggtgtcccccctcatcatctcccatgagatcaatgagaagagccctttctgggagatgtctcgtgctcaactggagcaggaagagtttgaggttgtggtcatactagaagggatggtagaagccacaggcatgacttgccaagcacggagctcttacatggatacagaggtgctctggggtcaccgattcacaccagtcctcaccttggaaaagggcttctatgaggtggactacaacactttccacgacacctatgagaccaacacacccagctgctgtgccaaggagctggcagaaatgaagaggaatggtcagctcctccagtccttgcccagtcctcctttgcttgggggctgcgctgaggctgagaaagaagcagaggctgagcacgatgaggaggaggaacccaatggactgagtgtgtcccgggcaacaaggggctcaatgtgaagcctgtgtgctacccagagcctcttcctgtcagacaccaaggagcctgagaggccagagaggcaattagttgagcaagctttgtggagtcccaggagtatgggacttctacaaagaggaacagtgtggtgaggcctcgcatctcctcctcagggcctcggagcaagtggcgttgactaggcctcccaagaagtgttttctcggcctctgtgaaggagagcattaggggtcaccagggtgggcttcccaaggaggagttcttaggtgtcatccatcctctctctgactgctgaagcctgctcactggcctccctgattctctgtttcctcagcacaatcactgaggcctgtgaatggagggactaattccatccatggatactcaggcctccaactggggatgagttcacagaggccttccaggggcaatgccctgcagtctgaggccaaaacccactgatttaatagcttcttagcaaggccccttaacctctgatactacctactgtgtgttttcctcttctgtgtcctcttccatgacactacggcttacagggtaattgatttaattagagtggccctaggacactgagtacctaggagcacacacaatgtcgtcctcacaactgcctggcactcctactcacacttcaaaggacagacacagcagttgtggcttttgtaggagtgtgtggcaaaagaacttcaaagaaccgacctctaaagcggtcccggggaacatgtgaatttcagagagccagattagctcattggtactaacatagggatggcagacaggaaagagacacaaggataattttaaaataagtatctggagcctggtgttgtgatgcatgcctgtaatcctagcatttggcaggctgaggcagaattgagaatttgaagccagccgggctatatagccctgtctgaaaaaagcaagagacaaactacaaccaaggaaacatctgccacagttgttgcatggggctcctcggagaaaagtaggctatgaaacacaagtgacaagaggccataaaggcatcttcactgccaagccaagtgtggaccagagtcttggctgccgctgagatgcctctgggcctcctccctatggaacagctccaacaggtggtgggacctagagggaggtccctgagaacaggatgagaggttggtgggtgactagggaaagaagagtctaagtgtggagcagagccttggggtccacagcctcagagacctttctcttccagtctaggagatctgatggtcggtcagtgaagcattatgttgaaaacaaagttggcctggtcttgggaatatgctagcatgatccccaacacctctacccgggtgttcatggctctcaaccagcctctgagaatagaagcaccttcctgccaggccctagagaactttctctggcatctccaaggagatgagacgctaaggctagggaacagcatcctaacctcaggccttgttccccttacagggtgcccaggtctctaggctggtgagaaggtgtcctaggatggctagctacattgtggaccagacacagatagaacaggggaaccttgacttgttatctgggctgaatcttgaaagacagtctaaagccagtggttctcaaccttcctaatgctgtgaccttttaatatagttcctcatgttgtgatgaccccaatcataaaattatttttgttcct

SEQ ID NO: 1996 - DNA, 2402 bp, Rattus norvegicus
  Genbank Accession No. NM_017299
acgccggctgctggttgaactaggtacgggcctgtgggacgcagagctggggatccattgtgagtgcctagggagccacaaggtgcggtcctgttccttccggcatcctgaagatgaaagcggactgaattctatctgcagtcctggcgcaactgcagagctccggcaggttgagcgtgccaagagcctgcgaagtggagtgtcatctttgcttaccaggtccatgaggacctggccaacatggtgcccactggccaggtcggagaaaagcaagcctgtgaagagcccaggcaggaccgagaacttaagtcctggcgatggctcgtgttctacctctgcttctttggcttcatggcacagttgcgacctggggagagcttcatcacaccctacctcctggaacgtaacttcaccaaggagcaggtgaccaacgagatcattccgatgctgccctactcccacctggccgtgctggtccccatcttcctgctcaccgactacctacgatacaagccagtcctggtcctacagtgcctgagcttcgtgtgcgtgtggctgctgctgctcctggggacctccgtcgtgcacatgcagctcatggaagtcttctacagcatcaccatggcggcgcgcatcgcctactcctcctacatattctccctggtgcagccctcccgctaccagcgcatggccagctactcgcgggccgcagtcctactgggcgtcttcatcagctccgtgctgggccaggtgctggtcaccctaggaggcatctccacctatatgctcaactgtatctccctgggcttcatcctcttcagcctgagcctctccctcttcctaaagcgtcctaagcggagcctctttttcaaccggagcgcacttgtgcaaggagccttgccctgtgagctggatcagatgcacccgggacctggccgtccagagcccaggaaactggagcgcatgctgggcacttgcagggactccttcctggtacgcatgctaagcgaactggtgaagaacgtccggcaaccacagctgcgtctctggtgcctctggtgggtcttcaactcggcaggctactacctgatcacctactatgtccatgtcctgtggaaaatcactgacagcagactcaactacaacggtgccgtagatgccgcctccacacttctgagcgccatcacggccttcaccgcgggcttcgtgaacatccgctgggctctgtggtcaaagctggtcatcgcgagtgtcatagccatccaggctggcctggttttctgtatgttccagatcccggacatctgggtctgctatgtgaccttcgtgcttttccgtggggcctaccagttccttgtgcccattgccacttttcagattgcatcttccctgtctaaagagctctgtgcattggtcttcgggatcaacactttccttgccactgcgcttaagacctcgatcacactcgtggtctctgacaagcggggtctgggcctccaagtccatcaacagttccgcatctacttcatgtacttcctgacgctgtccatcatctgccttgcctgggctgggctggacggcttgaggtactaccggcgtggtcgccaccagccgctggcccaggcccaggctctgagtcccttggaggattctgtgcaggcgataagcctacaggatggagacctaaggagaccgcagccctcggcaccacagctgctcccagaggatggcagcgtagaagacggcagggcagacttgagagtcgaagccaaggcctgacctgtcttcaccttcctggcttcatcccagttcagccgccggattcctgactcagtggcagcccctcctgtgtgcactccagcctgaatcagcccttctggggtcccagtgcctgagacatgtgggggcccccctgttgcctttcaggagccttcaggttaggccacagaactctctccttaggggccaccttttttaacagtggggcgacagacagcttgtccttccggtagcctctgaggaccctaagcccagcctacttcatgctttagcaatggctggagcctgctacagacactcaggaccgctccctggcttttgtgaaccacaatgtcaggccactacgagcctgggttgcctactgcttgccaagaagaacctgtgtaggggtcagctgtgcccaccaggctggtctgccctttgctctgggatgctcaggacaaatcacgtctgcccccagggctagtgaggtagcccagacaccggacaaggtccgctgagcctgcagggtactggttacctgtcctaggctcctggtgaagctgccatacctccactctcggaggtgcttgtttgtatggttgtctgattttttaaaacttgacattaaaatggagaactac

SEQ ID NO: 1997 - DNA, 1700 bp, Rattus norvegicus
  Genbank Accession No. NM_017304
acccatctttaggattcccagaacccaccatgcctgtttcacacatctgaaattctctattagcgctcctattgtgtttggagttttaaaaaaaattctaaagatttagcgtctcgtggatccagtgctggtccagggggtcgcccaatccgccgccacccacgcgaggagtcccgacctgagggataccgctcactcagcacagaacccgccccgcgtcacttttacgtcaaggtagcgcggccaatgagagccagagttcaatgattctgactctacgcgcgcggaccaatcgacgcatcggcgggagctgcaggatttgcatggactccgaaggccactgccaatgagactgtgactggcgtgaatcatagccaataataggatgctaggggcgtggccgcgggcgtcccacgaggtaaagatgctgcgggcggaacctgccggagcaagcgggattcgggggtgctgaagtcgcaagggcagggcgggaaggaagatccggaacggggcgtgggatccggagctggaggcccccaggatttcccctctgtgaaaagacacgctgatctagataagtgaggccggccccatgtatccggaatcaaccacggggtctccagctcgactctccctgcggcagacaggctcccccgggatgatctacagtactcggtatgggagtcccaaaagacagctccagttttacaggaatctgggcaaatctggccttcgggtctcctgcctggggcttggaacatgggtgaccttcggaggccagatcacagatgagatggcagagcacctaatgaccttggcctatgacaatggcatcaacctgttcgatacggcggaggtctacgcagctggcaaggctgaagtggtattagggaacatcattaagaagaaggggtggagacggtccagccttgtcatcaccaccaagatcttctggggcggaaaggcagagaccgagagaggcctttcccggaagcacataatcgaaggactgaaagcttccctggagaggctgcagctggagtacgtggatgtggtttttgccaaccgcccagaccccaacacacccatggaagagactgtgcgggccatgacccatgtcatcaaccaagggatggccatgtactggggcacatcacgctggagctccatggagatcatggaggcctactcggtggctcggcagttcaacctgatcccgcccatctgcgagcaagcggaataccacatgttccagagggagaaggtagaggtccagctgccagagctgttccacaagataggagtaggtgccatgacctggtcccctctggcctgcggcattgtctcagggaagtatgacagtggcatcccaccctactccagagcctctctgaagggctaccagtggttgaaggacaagatcctgagtgaggagggtcgccgccagcaagccaaactgaaggaactgcaggccattgcagagcgcctaggctgcaccctcccacagctggccatagcctggtgcctgaggaacgagggcgtcagctccgtgctcctgggtgcttccaatgcagaacaacttatggagaacattggagcaatacaggtccttccaaaattgtcgtcctccatcgtccacgagatcgacagcattctgggcaataaaccctacagcaaaaaggactatagatcctaagtca

SEQ ID NO: 1998 - DNA, 1382 bp, Rattus norvegicus
  Genbank Accession No. NM_017305
gaattccggccttccctccgtggctccggcgctgcccggtcccctcgggcggcagctgccatgggcaccgacagccgcgcggccggagcacttctggcgcgggccagcaccctgcacctgcagaccgggaacctgctcaactggggccgcctgcggaaaaagtgtccgtccacgcacagcgaggagcttcgagactgtatccaaaagaccttgaatgaatggagctcccaaatcagccctgatttggtcagggagtttccagatgttttggaatgtaccatgtcccatgcagtggaaaagataaaccctgatgaaagagaagaaatgaaagtttctgctaaactgttcattgtaggatcgaattcttcatcatcaactagaaatgcagttgacatggcatgctcagtccttggagttgcacagctggactctgtcatcatggcttcccctccaattgaagatggagttaatctttccttggagcatttgcagccttactgggaggaattagaaaacttagttcagagcaagaagattgttgctataggcacctcggatctagacaaaacacagttggagcagctgtaccagtgggcacaggtaaaacccaatagtaatcaagttaatcttgcctcctgctgtgtgatgccaccagatttgactgcatttgctaaacagtttgacatacagctactgactcacaatgacccaaaagaactgctctctgaggcaagtttccaggaagctcttcaagaaagcatccctgacattgaagcccaggagtgggtgccactgtggctgctgaggtactcggtcatcgtgaaaagcagaggaatcatcaagtcaaaaggatacattttgcaagccaaaagaaagggttcttaactacagctcaagctcacaactcaggggccttgtatttatctggaacataagataaaaattcatgataaaattgagatgtgtaaaaaaaaatctagctctcgcctacaaaaagcgtcactgaggcgtgaatgtggtggtttggcaatgtgttgagtttaagtacctccctggcgtctgcagcagcgcactcacaggaagcattgtattctcttcattaaactcttggtttctaactgaaatcgtctataaagaaaaatacttgcaatatatttcctttatttttatgagtaatagaaatcaagaaaatttgttttaagatatattttggcttaggcatcagggtgatgtatatacatattttttatttctaaaattcagtaactgcttcttactctatacttctataactaagcaattacattacagttgttaagacatactggaagagatttttttcctgtcgtttgacaaaataatctatctcagagtcggaattc

SEQ ID NO: 1999 - DNA, 987 bp, Rattus norvegicus
  Genbank Accession No. NM_017306
cccaccgatatccaaaatggcgctggctgctgcgcgtcgcgttctgctgcaggccggatcccgcctcggccgcaggggggccgtggacggcgcgcgtcgcttctctaacaagcgggtgttggtggagaaggagggcgaggcaggaatcgcagtgatgaagttcaagaaccctccagtgaattccctcagcttggagtttctgacagagttcgtcatcagcctggagaagctggaaaatgacaagagcatccgaggtgtcatcctcacttcggagcgcccgggtatcttctcggctggcctggacttgatggagatgtatggccggaacccagcccactatgctgagtactggaaggctgtgcaggagctgtggctgaggctctacttgtccaacctgaccttgatatctgccatcaatggcgcctctccagctggaggctgcctcatggctctcacctgtgactacaggataatggcggacaactccaagtataccataggattgaatgagagcctgctgggcattgttgcccccttctggttaaaagacaactacgtgaacaccatcgggcaccgagcagccgagcgtgcccttcaactggggacgcttttcccaccagcagaggccctcaaggtgggtttggtggatgaggtggtacctgaggatcaggtacacagcaaggctcgctcagtgatggccaagtggttcaccattccggaccattctcggcagctgacgaagagcatgatgcggaaggccacggcggacaacctgatcaagcagcgagaggctgacatccagaacttcaccagtttcatctccagagactccatccagaagtccctgcacgtgtacttggaaaagctcaagcaaaagaagggctgacctaagggtgccacacgggtgtttagttacacgtgccttctaggacccatggtcccaaggattatcaataaggtatttttcaatttaaaaaaaaaaaaaaa

SEQ ID NO: 2000 - DNA, 561 bp, Rattus norvegicus
  Genbank Accession No. NM_017311
gtgtgctgtgggccgagcaggggctgcaggggagtgggagtgcagattgaaaaatgcagaccacgaaggcactgctcatttctccagttctgatccgctcctgtaccaggggtctaatcaggcctgtgtctgcctccctcctgagtagaccagaggctccatctaaaaagccttcctgctgcagctcccctctccaggtggccagacgggaattccagaccagtgttatttcccgggacattgacacagcagccaagtttattggtgctggggccgccacagttggtgtggctggatcaggggctggcattggcacagtgtttggtagcttgattattggctatgccaggaacccgtctctcaagcagcagctcttctcctatgccatcctgggctttgccctgtctgaggccatggggctcttctgtttgatggtcgccttcctcatcctcttcgccatgtgaggctccatggggtcacccggccgtccctgctgctttgactccatgccagtcctggtgctggagtgtgctgagctttaccattaaactacgtttctct

SEQ ID NO: 2001 - DNA, 2472 bp, Rattus norvegicus
  Genbank Accession No. NM_017315
cagagatgaaagctcaggaggaccccgggagctcaaagcagcatgaatgcccagattcagcagggacttccaccagggaccagcaggcacctttgcccgcggagcccaagtttgacatgttgtacaagattgaggacgtgccaccatggtacctgtgtatcctgctgggcttccagcattacctgacatgcttcagtggtaccattgctgtgcccttcctcctggctgaggcgctgtgtgtgggccgcgaccagcacatgatcagtcagctcattggtaccatcttcacctgcgtgggtatcaccactctcattcagactacagtgggcatccggctgccgctgttccaggccagtgcctttgcgtttctggttccagccaaggctatcctggccttggagaggtggaagtgtcctccagaagaggagatctacggtaactggagtatgcccctgaacacctctcatatctggcatcctcggattcgggaggtccagggtgcaatcatggtgtccagcgtggtagaggtggtgattgggctgttggggctgcctggggccctgctcagctacattggacctctcacagtcacccccactgtctcccttatcggtctctctgttttccaagctgctggcgaccgagctggctcccattggggcatttcggcttgctccattctactgatcgtcctgttctcccagtatctacgcaacctcaccttcctgttgcctgtttaccgatggggcaagggtcttactctcttccgcatccagatctttaagatgtttccgatcgtgctggccatcatgaccgtgtggctactctgctatgtgctgactctgacagacgtgctgcccgcagatcccacagtctacggtttccaggctcgaactgatgcccgaggggacatcatggctatctctccctggatccggatcccctacccatgtcaatggggcctacccacagtgaccgtggctgcagttctgggaatgttcagcgccacactggcgggcatcatcgagtccatcggtgattactatgcctgcgcccggttggctggagcaccaccccctccagtccatgctatcaacagggggattttcaccgaaggcgtctgctgcatcatcgctgggctactgggcacaggcaacgggtccacctcttccagccccaacatcggggtcctagggattaccaaggtgggcagccgaagagtcgtgcagtatggtgcaggtatcatgctaatcctgggggccattggcaaattcacagctctcttcgcctcactgccggaccccatcctgggagggatgttctgcactcttttcggtatgatcaccgctgtgggactgtccaatctgcagtttgtggacatgaactcctcccgcaacctctttgtattgggattctccatgttcttcggcctcacgctacccaactacctggattccaacccaggtgccatcaacacaggcgttcctgaagtggatcagatcctaactgtgctgctgaccacagagatgtttgttggtggctgtcttgctttcatactggacaacacagtaccagggagcccagaggaaagaggtctgatacagtggaaagccggggcacacgccaacagtgagacgctggccagtctcaagagctacgatttcccgttcgggatgggcatggtaaaaaggaccaccttttttagatacatccccatctgcccagtcttcagaggattctctaagacagaaaatcagcctgcagttctagaagacgctccagacaacacagaaactgggtctgtgtgtaccaaggtctgaaactacctctatgaaaggaggcacggtgtgtatcaggaaaacaaactacccaggagacagaagacctgagttggagatctcagctgtccctattctaaattcccatggaagactggacagatcaccctctctttgactccattttcgtgacagcccaagtctctaagtcctcgggagacctgtatttgcactgctctgattccttacttccactttcctaagcatgcatgtcaaggaggaagagctggagaaaaaaaaggaaacccagagagattctagggcttcatgtagacatgaagatagggttaaaaacaaaccaaacaaaaccccctgaattccaatgctatgtattttaagaccaaaacagtattaaataatatactggaccaataatttagataagtttagataagtattctcccttcacacagggaaaataaatttatactttcagactagctcagtgataaagatgtctatttagaatgttccagaactgggcttgaccttcaacattaaatatacagaaataaaaacccttaagaggaaaaaaaaaggggttggggatttagctcagtggtagagcgcttgcctagcaagcacaaggccctgggttcggtccccagctccgggaaaaaaaaaaaaaaaaaaa

SEQ ID NO: 2002 - DNA, 1330 bp, Rattus norvegicus
  Genbank Accession No. NM_017320
gggactctctcatgccgccatacggagatggctgttttgggtgcccctggtgtgctctgtgacaatggagcaactgcagagagacctaccctggaccaccactgggatctctggaagaaaactcgcatgagaaggaatacagatcagaatgaagaagacgtacgacgtctcatctgggaaaagaatctcaagtttataatgcttcacaatctggaacattctatgggaatgcattcatacagtgtgggcatgaaccacatgggagacatgacacctgaagaagtcataggttatatgggctctctgagaattcccaggccctggaatagaagtggcactctcaagtcaagctctaatcagacattgcccgactctgtggactggcgagaaaagggctgcgtcactaatgtgaaataccagggctcttgtggttcctgctgggctttcagcgccgagggggcccttgaagggcagctgaagctgaaaacggggaagctggtgtctctcagtgctcagaacctggtggattgctcaaccgaagaaaagtacgggaataaaggctgcgggggtggcttcatgaccgaagctttccagtacatcatcgatacgagcatcgactcagaagcttcctatccctacaaagccatggatgaaaagtgtctctatgacccaaaaaatcgagctgccacgtgttcaaggtacattgagctccccttcggcgatgaagaagctctgaaagaagcagtggccactaaagggcctgtctctgtgggcatcgacgacgccagccattcctccttcttcctctaccaaagtggtgtctatgatgacccctcctgtaccgagaatatgaatcatggtgttctcgtggttggctatgggactcttgatgggaaagactactggcttgtgaaaaacagttggggccttcactttggtgatcaaggatatattcggatggcgagaaataacaaaaatcactgcgggattgctagctattgctcttacccagaaatctaaaccgtttcttctttttctaatgggtcacaaagacggaatacactctaatttaattttgtctgctccatccggaggacccaagtgtgtcgtgatcagtgtgtacatactgtgctaactggcttacagcttgtttgttttataactttacctctctctgaaaagtctgtaagcaaggacgcgctgaggatggagctggcagtctgtcctagatattctttctatgcttgcaccctgtcgtctaatgtgtctaataaccctttgtaacacagatatccccaaagtgcctaataaaatctgtcatttcaagctc

SEQ ID NO: 2003 - DNA, 798 bp, Rattus norvegicus
  Genbank Accession No. NM_017328
cgcgtcccctgcccaccatggccacccaccgcctagtaatggtccgccacggtgagagctcatggaaccaagagaaccgtttctgtggctggtttgatgcagaactgagtgagaagggggcagaggaggccaagcggggggccactgccatcaaagatgccaagatagagtttgacatctgctacacgtcggtgctgaagcgggctatccgcaccctttggaccatcctggatgttacggaccaaatgtgggtgcccgtggtgcgcacctggcgcctcaatgagcggcactatggaggtctcacgggcctcaataaggctgagacggctgcaaagcatggggaggagcaggtgaagatctggaggcgttcctttgacaccccgccaccacctatggacgagaaacacaactactacgcctccatcagcaaggatcggcgctatgcaggcttgaagcctgaggagctgcctacctgtgagagcctcaaggacaccattgcccgggctctgcccttctggaatgaggagatcgcacctaagattaaggctggcaagagagtccttattgcagcccatgggaacagccttcgaggcattgtcaagcatctggaagggatgtcagaccaggccatcatggaactgaatctgcccaccggaatccccattgtctatgagctgaaccaggagctgaagcccaccaagcccatgaggttcctgggagacgaagagacagttcggaaggccatggaggctgtggctgcccagggaaaggcaaagtgagagtgggtgggcggaattc

SEQ ID NO: 2004 - DNA, 9136 bp, Rattus norvegicus
  Genbank Accession No. NM_017332
agagacggcagcagcgtcccgtccagttcgcctgccgcgctcgcttgtcgtctgcctccagatcccagacagagaagagccatggaggaggtggtgatagccggtatgtccgggaaattgcccgagtcagagaacctgcaggagttctgggccaacctcattggcggtgtggacatggtcacagacgatgacaggaggtggaaggctgggctctatgggttgcctaagcggtctggaaagctgaaggatctgtccaagttcgacgcctccttttttggggtccaccccaagcaggcacacacaatggacccgcagctccggctgctgctggaagtcagctatgaagctattgtggacggaggtatcaacccggcctcactccgaggaacaaacactggtgtctgggtgggtgtgagtggttccgaggcgtcggaggccctgagcagagatcctgagactcttctgggctacagcatggtgggctgccagagagcaatgatggccaaccggctctctttcttcttcgacttcaaaggacccagcattgccctggacacagcctgctcctctagcctactggcactacagaatgcctatcaggctatccgcagtggggagtgccctgctgccattgtgggcgggatcaacctgctgctaaagcctaacacctctgtgcagttcatgaagctaggcatgctcagccccgatggcacctgcagatcctttgatgattcagggaacgggtattgccgtgctgaggctgtcgtggcagttctgctgactaagaagtccttggctcggcgagtctatgccactattctgaatgccgggacgaacacagatggctgcaaggagcaaggcgtgacattcccctctggagaagcccaggaacaactcatccgttctctgtatcagccgggcggtgtggcccccgagtctcttgaatatattgaagcccatggcacgggcaccaaggtgggggacccccaggaactgaacggcattactcggtccctgtgtgctttccgccagagccctttgttaattggctccaccaaatccaacatgggacaccctgagcctgcctcggggcttgcagccctgaccaaggtgctgttatccctagaaaatggggtttgggcccccaacctgcatttccacaaccccaaccctgaaatcccagcacttcttgatgggcggctgcaggtggtcgataggcccctgcctgttcgtggtggcatcgtgggcatcaactcgtttggcttcggaggtgccaatgttcacgtcatcctccagcccaacacacagcaggccccagcacctgccccacatgctgccctaccgcatttgctgcatgccagtggacggaccatggaggcagtgcagggcctgctggaacagggccgccagcacagtcaggacttggcctttgtgagcatgctcaatgacattgcagcaacccctacagcagccatgcccttcagaggttacactgtgttaggtgttgagggccatgtccaggaagtgcagcaagtgcctgccagccagcgcccactctggttcatctgctcagggatgggcacacagtggcgtggaatggggctgagccttatgcgcctggacagtttccgtgagtccatcctgcgctctgatgaggctctgaagcccttgggagtcaaagtgtcagacctgctgctgagcactgatgagcacacctttgatgacatcgtgcattcctttgtgagcctcaccgccatccagattgccctcatcgacctgctgacgtctatggggctgaaacctgatggcatcattgggcactccttgggagaggttgcctgtggctatgcagatggctgtctctcccagagagaggctgtgcttgcagcctactggagaggccagtgcattaaggatgccaaccttccggctggatccatggcagctgttggtttgtcctgggaagaatgtaaacaacgctgccctcctggtgtggtgcctgcctgccacaactctgaggacactgtgaccatctctggacctcaggctgcagtgaatgaatttgtggagcagctaaagcaagagggcgtgtttgccaaggaggtgcgaacaggtggcctggccttccactcctacttcatggaaggaattgcccccacgctgctgcaggctctcaagaaggtgatccgggagccacggccacgctcagcacgctggctcagcacctctatccctgaggcccagtggcagagcagcctggcccgcacatcttctgctgagtacaacgtcaacaacctggtgagccctgtgctcttccaggaagcactgtggcacgtccccgagcacgccgtggtgctggagattgcaccccatgcactgttgcaggctgtcctgaagcgaggcgtgaagcctagctgcaccatcatccccttgatgaagagggaccataaagataacttggagttcttcctcaccaacctcggcaaggtgcacctcacaggcatcgacatcaaccctaatgccttgttcccacctgtggaattcccggttccccgagggactcctctcatctcccctcacatcaagtgggaccacagtcagacttgggatatcccagttgctgaagacttccccaacggttccagctcctcctcagctacagtctacaacattgacgccagttccgagtcatctgaccactacctggtcgaccactgcattgacggccgtgtcctcttccctggcactggctacctgtacctggtgtggaagacactggctcgaagcctgagcttgtccctagaagagacccctgtggtgtttgagaacgtgacatttcatcaggccaccatcctgcccaggacaggaaccgtgcctctggaggtgcggctgctagaggcctcacatgcatttgaggtgtctgacagtggcaacctgatagtgagcgggaaagtgtaccagtgggaagaccctgactccaagttattcgaccacccagaagtcccgatccccgccgagtccgagtctgtctcccgcttgacgcagggagaagtatacaaggagctgcggctacgtggctatgactatggccctcatttccagggcgtctatgaggccaccctcgaaggtgagcaaggcaagctgctctggaaagacaactgggtgaccttcatggacacaatgctgcagatatccatcctgggcttcagcaagcagagtctgcagctacccacccgtgtgactgccatctatattgaccctgcaacccacctgcagaaggtgtacatgctggagggagacactcaagtggctgacgtgaccacgagccgctgtctgggcgtgaccgtctctggtggtgtctacatttcgagactacagacaacagcaacctcacggcggcagcaggaacagctggtccccaccctggagaagtttgtcttcacaccccatgtggagcctgagtgcctgtctgagagtgctatcctgcagaaagagctgcagctgtgcaagggtctggcaaaggctctgcagaccaaggccacccagcaagggctgaagatgacagtgcctgggctagaggaccttccccagcatggactgcctcgactcttggctgctgcctgccagctgcagctcaacgggaacctgcaactggagttaggtgaggtactggctcgagagaggctcctgctgccagaagaccctctgatcagtggcctccttaactcccaggccctcaaggcctgcatagacacagccctggagaacctgtctactctcaagatgaaggtggtggaggtgctggctggagaaggccacttgtattcccacatctcagcactgctcaacacccagcctatgctgcaactggagtatacagccaccgaccggcacccccaggccctgaaggatgttcagaccaagctgcagcagcatgatgtagcacagggccagtgggacccttctggtcctgctcctaccaacctgggtgctcttgaccttgtggtgtgcaactgtgcgttagccaccctgggggatccagccctggccctggacaacatggtagctgccctcaaggatggtggtttcctgctaatgcacacagtgctcaaaggacatgcccttggggaaaccctggcctgcctcccttctgaggtgcagcctgggcccagcttcttaagccaggaagagtgggagagcctgttctcaaggaaggcactgcacctggtgggccttaaaaagtcattctacggtactgcgctgttcctgtgccgccgtctcagcccacaggacaagcccatcttcctgcctgtggaggatactagtttccagtgggtggactctctgaagagcattctggccacatcctcctcccagcctgtgtggctaacagccatgaactgccccacctcaggtgtggtaggcttggtgaactgtctccgaaaagagccgggtggacaccggattcggtgtatcctgctgtccaacctcagcagcacatctcacgtccccaagctggaccctggctcttcagagctacagaaggtgctagagagtgatctggtgatgaacgtgtacagggacggtgcctggggtgccttccgtcacttccagttagagcaggacaagcccgaggagcagacagcacatgcctttgtaaacgtccttacccgaggggaccttgcctccatccgctgggtctcttctcccctgaaacacatgcagccgccctcgagctcaggagcacagctctgcactgtctactatgcctcactgaacttccgagatatcatgctggccacgggcaagctgtcccctgatgccattccaggtaaatgggccagccgggactgcatgcttggcatggagttctcaggccgtgataagtgcggccggcgtgtgatggggctggtacccgcagaaggcctggccacctcagtcctgttatcacccgacttcctctgggatgtaccctctagctggaccctggaggaggcggcttctgtgcctgttgtctacaccaccgcctactactccttagtagtgcgtggtcgtattcagcacggggaaactgtgctcattcactcgggctccggtggtgtgggccaagcggccatttccattgcccttagcctgggctgccgagtcttcaccactgtgggctccgctgagaagcgagcttacctccaggccagattccctcagctggatgacaccagctttgctaactctcgagacacatcgtttgagcagcatgtgttactgcacacaggtggcaaaggggtggacctggtcctcaactccctggcagaagagaagctgcaggccagtgtgcggtgcttggctcagcatggccgcttcctagagatcggcaaatttgatctttctaacaaccaccctctgggcatggccatcttcttgaagaacgtcactttccatgggatcctgctggatgcactttttgagggggccaacgacagctggcgggaggtggcagagctgctgaaggccggcatccgtgatggggttgtgaagcctctcaagtgtacagtgtttcccaaggcccaggtggaggacgccttccgatacatggctcaaggaaaacatattggcaaagtccttgtccaggtacgggaggaggagcccgaggctatgctgccaggggctcagcccaccctgatttccgccatctccaagaccttctgcccagagcataagagttacatcatcactggtggcctaggtggctttggcctggaactggcccggtggcttgtgcttcgtggggcccaaaggcttgtactaacttcccgatctggaatccgcacaggctaccaagccaagcacgttcgggagtggaggcgccagggcatccatgtgctagtgtcgacaagcaatgtcagttcactggagggggcccgtgctctcatcgctgaagccacaaagcttgggcccgttggaggtgtcttcaacctggccatggttttaagggatgccatgctggagaaccagactccagaactcttccaggatgtcaacaagcccaagtacaatggcaccctgaaccttgacagggcgacccgggaagcctgtcctgagctggactactttgtggccttctcctctgtaagctgcgggcgtggtaatgctggccaatccaactatggcttcgccaactctaccatggagcgtatttgcgaacagcgccggcacgatggcctcccaggtcttgccgtgcaatggggtgccattggtgacgtgggcattatcttggaagcgatgggtaccaatgacacagtcgttggcggcacactgccacagcgcatctcctcctgcatggaggtgctggacctcttcctgaatcagccccacgcagtcctgagcagttttgtgctggttgagaagaaagctgtggcccatggtgatggtgaagcccagagggatctggtgaaagcagtggcacacatcctaggcatccgcgacctcgcagggattaacctggacagctcgctggcagacctcggcctggactcgctcatgggtgtggaagtgcgccagatcctggaacgtgaacatgatctggtgctacccattcgtgaagtacggcaactcacactgcggaagcttcaggaaatgtcctccaaggctggctcagacactgagttggcagcccccaagtccaagaatgatacatccctgaagcaggcccagctgaatctgagtatcctgctggtgaaccctgagggccctaccttaacacgactcaactcagtgcagagctctgagcggcctctgttcctggtgcaccccattgaaggttccatcactgtgttccacagcctggctgccaagctcagtgtgcccacctacggtctgcagtgcacccaagcggcccccctggacagcattccaaacctggctgcctactacattgattgcatcaagcaggtgcagcctgaggggccccaccgagtggctgggtattcttttggagcttgtgtagccttcgagatgtgctcccagctgcaggcccagcagggcccagcccccgcccacaacaacctcttcttgtttgatggctcacacacctacgtattggcgtacacccagagctaccgggcaaagctgaccccaggctgtgaggctgaggctgaagctgaagccatatgcttcttcattaagcagtttgttgatgcagagcatagcaaggtgctagaggccctgctaccactgaagagcctggaggaccgggttgctgctgctgtggacctcatcactagaagccaccagagcctggaccgccgtgacctgagctttgctgccgtgtccttctactacaagcttcgagccgccgaccagtataaacccaaggccaagtaccacggcaatgtgatcctgctgcgggccaagacaggtggcacctacggcgaggacttgggtgccgattacaacctgtcccaggtgtgtgatgggaaggtgtctgtgcacatcattgagggtgaccatcgtacgctgctggagggcaggggcctggagtctatcatcaacatcatccacagctccctggctgagcctcgagtgagtgtacgggagggctagacctgcctaccatgaagccacgacccacaccggccaccagagatgctccgatccccatcacaccctgagtgcagggactggggagggtcctgctggtgggaccccctcaccccagtggcccagcaccaccccctcccctggtggctgctacaaacaggaccatcacatgtgtcccagccacttagtggggttcccagagccactgacttggaggcaccctggtctgtgaagagtcagtggaggccagcaagagccaaactgagccttttctgccaagtgacatttgtcacactggttgtttctccattaaattctcatatttattgcattgctgggaaagaccgcccaccccagggttaactcattccagaacccctaaagtgggaaaagccatgtggggaaggctgctggctggagcccctttttgtcttagccctgtacccgctcactgcagggcagggtatggagagggctggttcccggggaacgaggaccccagcagacactgtagcccatggcccttggtccccagcactcccggctgcacccatgatgcagggcctaccagactctgcggaccgcaccgggcactcactgtatttgttttccaagattcaaattgctgcttgggttttgaatttactgcagctgtcagtgtaaagaaacatgtctgaactgtgtcctttttacaccaacctggtaaaaatgctcttgatgctgtcccgttgccacaattaaactgcacgtgagctctggcttccgttcagtctctttccagtcccagacctgagtccccagagcctccacagctcttacagtgagaatcaaattggcccactccttggaaggcgtggcattctgtcagagtaaaaggaaagtagagtgtgctgattcacgttcagcgtgtggggctggctagagaccttggcactgtagtgaacagaatgtgtccacctttaagtcaccctgaaggcatcaccatagctacagcctcacccaggggtagagaatagtactgtctacttgttgactacctggcagttggtgccagcccctatagaggaaaacagcagtgtgtggccactgtgagaagcatatccctggaaacaggtgaccagagcagagggctaatgcctacctgagtcacacaaaactgaccaggcttgagtgtccagaagagtctatcagaaggccacagcattcagtcctatccacagagagcagcagactaagttgtctccttgccagcttagaaaactgcagtgctggggtacaggtagggtgttcaggaggtccgggccccagtgattagtctaagactgaagcatctggttggctgtggtcccacctagaaaattcttaaagctcttgtcatgtacttcctgggaaggacctaccctgtctcaataatgtctctagctcgttggagtctactgactcaaacatttataaagtgtcctagaaaggcctgactcccctacaaggctgtgtgatccttcaaactcacatatgtgagccaataaaaccttgagactct

SEQ ID NO: 2005 - DNA, 436 bp, Rattus norvegicus
  Genbank Accession No. NM_017334
actttattttggactgtggtacggccaacaagaccactctgtatgcaaaagcccaacatggctgtaactggagatgaaactgatgaggagactgaccttgccccaagtcacatggctgctgccacaggtgacatgccaacttaccagatccgagctcctactactgctttgccacaaggtgtggtgatggctgcctcaccaggaagcctgcacagtccccagcaactagcagaagaagcaactcgcaagcgggagctgaggctgatgaaaaacagggaagctgctaaagaatgtcgacgtcgaaagaaagagtatgtcaagtgtcttgagagtcgagtcgcagtgctggaagttcagaacaagaagcttatagaggagcttgaaactttgaaagacatttgctctcccaaaacagattagtagaaatatttaacta

SEQ ID NO: 2006 - DNA, 1139 bp, Rattus norvegicus
  Genbank Accession No. NM_017343
agatttgaaccgccaccatgtcgagcaaaaaagcaaagaccaagaccaccaaaaagcgccctcagcgcgcaacgtccaacgtgttcgccatgtttgaccagtcccagatccaggagttcaaagaggccttcaacatgatcgaccagaaccgggacggcttcattgacaaggaggacctacacgacatgctcgcgtctctggggaagaaccccaccgacgcctacctggacgccatgatgaacgaggccccgggccgcatcaatttcaccatgttcctcaccatgtttggagagaagctgaacggcaccgacccagaggacgtcatcagaaacgccttcgcttgcttcgatgaggaagccacaggcaccatccaggaggattacctgagggagctgctgaccaccatgggtgaccgcttcacagatgaggaagtggatgagctgtacagggaggcccccatcgacaaaaagggcaatttcaactacatcgagttcacgcgcatcctcaagcacggagcgaaagacaaagatgactgaagaggctgcagctgacattcctgttgagtttccttattcacttcatgtctcagacacagcccccataggacctactgtgtgccactttgtgtccctcagacaccccctcccataggcctactgtgtgccgcttagtccctcagacaccccctcccataggcctactgtgtgccacttagtccctcagacaccccctcccataggcctactgtgtgccatttgtccctcagacaccccctcccataggacctactgtgtaccacttggtttctcagacagccccacccccaaacccccctaaggacctactgcgggccacttagtttcacagcctttcctttttttaatgtatttattccagaccctttctgccacttagcatgtgtataatcagactggaatggggacaatgttgtaattgtactgaaaatgagatgcaaataaaaaaatcaaccaatgtgaaagcccaggaaaatatatcggcatttctggttttgctggatttttttacatttttatataataaaaatgttattttgaaataaagattatgctgactcaaggtggagtataaaacaaaaaaaaaaaaaaaaaaaaaaaaaa

SEQ ID NO: 2007 - DNA, 2155 bp, Rattus norvegicus
  Genbank Accession No. NM_017344
gggcacgccggagcccgaacggcgcagcctggaagaggccggagcccaagggaggcggcggtagaggcagcggcgggggcagcccaggcagcccgagccccgcggcctgggcctgcgctcggcgccatgagcggcggcgggccttcgggaggtggccctgggggctcgggccgggcgcggaccagctcgttcgcggagccaggcggcggaggcggaggcggtggcggcggccccgggggctcggcctccggcccaggaggcactggcggcgggaaggcgtcagtcggggctatgggtgggggcgtgggagcctcgagctctgggggtggccccagcggcagcggcggaggaggcagcggtggccccggcgcgggcactagcttcccgccgcccggagtgaagctgggccgtgacagcgggaaggtgaccacagtggtagccactctaggccaaggcccagagcgttcccaagaggtggcttacaccgacatcaaagtgattggcaatggctcattcggagtagtgtaccaggcacggctggcagaaacgagggaactggtggccatcaagaaggttcttcaggacaaaaggttcaagaaccgagagctgcagattatgcgtaagctggaccactgcaatatcgtgaggctgcggtactttttctactccagtggggagaagaaagatgagctgtatttaaatctggtgctggaatatgtgcccgagaccgtgtaccgagtggcccgtcactttaccaaggccaagttgatcatccctatcatctatgtcaaggtgtacatgtaccagctcttccggagcttggcctacatccactcccaaggtgtgtgtcaccgtgacatcaagccccagaatttgcttgtggaccctgacactgctgtcctcaagctctgcgactttggcagtgcaaagcagttggttcggggggagcccaacgtgtcctacatctgttctcggtactaccgtgctccggagctcatctttggagccacagattacacctcgtccatcgatgtgtggtcagctggctgtgtactggctgagctgcttcttggccagcccatcttccctggggacagtggggtagaccagcttgtggagatcatcaaggtactagggacgccaaccagggagcaaatccgagagatgaaccctaactacacagaattcaagttcccccagatcaaagctcacccctggacaaaggtgttcaaatctcggacaccacctgaggccatcgcactctgctctagcctgctggagtacactccatcctcaaggctctccccactagaggcctgtgcccacagtttctttgatgaactgcggagtctcggaacccagctccccaacaaccgcccgcttccccccctcttcaacttcagtcctggtgaactttccatccaaccgtctctcaatgccattctcatccctcctcacttgaggtccccatcaggccctgctaccctcacctcgtcctcacaagctttaactgagactcagactggccaagactggcaggcacctgatgccacacctaccctcactaactcttcctgagggccctaccgactacccctcacgctcactcggaaggctcaagtgggctggaaagggccatagcccatccagctcctgcctgctggccctagactgagggcagaggtaaatgaactacccagcatctaggcctccctcaccagcctcaccttgtggtggcttttaaagaggatttaactgtttgtgggggagggaagggaagagaaggacggacggggtttggggtatgaggaccttctacccccgtggtcccctcccctcccccaggctaccactcctcccccccctcccatgtcccttgtaaatagaaccagcccagccgtatcctcttcctggcccttgggtgtaaatagattgttataatttttttcttaaagaaaacgtcgattcacaccatccaacctgccctccccctcagctgtacccccctcttgtcctctgctcccaaggcttcctccctctccccatcccaaggaggggagtagggagagcccctggtgtcttagtttccacagtaaggtttgcctgtgtacagacctccgttcaataaattattggcatgaaaaaaaaaaaaaaa

SEQ ID NO: 2008 - DNA, 1238 bp, Rattus norvegicus
  Genbank Accession No. NM_017347
cggggggaggcggcagcagtggagatggcggcggcggcggcggctccggggggcgggggcggggagcccaggggaactgctggggtcgtcccggtggtccccggggaggtggaggtggtgaaggggcagccattcgacgtgggcccacgctacacgcagctgcagtacatcggcgagggcgcgtacggcatggtcagctcagcatatgaccacgtgcgcaagaccagagtggctatcaagaagatcagccccttcgagcatcaaacctactgtcagcgcacgctgagagaaatccagatcttgctcggattccgccatgagaatgtcataggcatccgagacatcctcagagcacccaccctggaagccatgagagatgtttacattgttcaggacctcatggagacggacctgtacaagctgctaaagagccagcagctgagcaatgaccacatctgctacttcctctaccagatcctccggggcctcaagtacatacactcggccaatgtgctgcaccgggacctgaagccctccaatctgcttatcaacaccacctgcgaccttaagatctgtgattttggccttgcccggattgctgaccctgagcacgaccacactggctttctgaccgagtatgtggccacacgctggtaccgagccccagagatcatgcttaactccaagggctacaccaaatccattgacatctggtctgtgggctgcattctggctgagatgctctccaaccggcctatcttccccggcaagcactacctggaccagctcaaccacattctaggtatactgggttccccatcccaagaggacctaaattgtatcattaacatgaaggcccgaaactacctacagtctctgccctctaaaaccaaggtggcttgggccaagctttttcccaaatctgactccaaagctcttgacctgctggaccggatgttaacctttaacccaaacaagcgcatcacagtagaggaagcactggctcacccttacctggaacagtactatgatccgacagatgaaccagtggctgaggagccattcacctttgacatggagctggatgatctccccaaggagcggctgaaggagctgatcttccaagagacagcccgcttccagccaggggcaccagaggccccctaacaagaacagacacccctgtccttttggacctggtctgctctacctgctccttctctgcagattgttagaaa

SEQ ID NO: 2009 - DNA, 3972 bp, Rattus norvegicus
  Genbank Accession No. NM_017348
gggagttaccacacggtcttccaagggcactgccaaggatggagtttctaggacggtcagggtagcatttgcggaaacagagccagctgagttctgggcagtgcagctgtagacccccatgtcgtcgactttcacatcagtgatgaagaacacatcgtcatctggcataacgtgcatgcgtcgctctcgagctgcagggaaatcggtgcctccatccttctgccaggcaatctgagggttagggtggcccgtggcagcacactcgaggcgtgctgtggtgcccgtccgaatggcaatgtcatggggtattttggtgaatgaaggcaacacattcacagtgagcctggctttgtgtgagtatgtggagccgaagtggtttgtgatgacacactggtagcggccctcgtgtccaaacgtgacgtgacggaggtgcaggatggtggtgtactccatcacttcgccgtcccgcacccctcccgcccgcccgtcgccccgtcccccggcccggccgcccccgaggcccccgggcgggcccgcgctttcggggccctttctccaggtgccaccggagccccttgcccgctcgccaccctcgagacgccgcgacccctggcctggcctcgcggcccaggggccatggcgaagaagagcgctgaaaacggtatctatagcgtgtctggagacgagaagaagggtcctctcatcgtgtccgggcccgatggtgccccgtccaagggcgatggccctgcgggcctgggggcgcccagcagccgccttgctgtgccgccgcgagagacttggacacgccagatggacttcatcatgtcgtgcgtgggcttcgccgtgggcctcggtaacgtgtggcgcttcccctacctgtgctacaagaacggcggaggtgtgttccttattccctatgtcctgattgccctggttggaggaatccccattttcttcctggaaatctcactgggccagttcatgaaggccggcagcatcaatgtctggaacatctgtcccctattcaaaggtctgggctatgcctccatggtgattgtcttctactgcaacacttactacatcatggtgctggcctggggcttctattacctggtcaagtcctttactaccactttgccatgggctacgtgtggccacacctggaacactcctgactgtgtagagatctttcgccatgaagactgtgccaatgccagcttggccaacctcacatgtgaccagcttgctgaccgacggtcccctgtcatcgagttctgggagaacaaagtcttgaggctctccacagggctggaggttccaggagccctcaactgggaagtgaccctgtgcctgctggcctgctgggtgctggtctacttctgtgtgtggaagggggtcaagtcaacaggaaagatcgtgtacttcactgctacattcccctacgtggtcctcgttgtgctgctggtgcgaggggtgctgctgcctggagccctggatggtatcatctactatctcaagcctgactggtcaaagctagggtcccctcaggtatggatagatgctgggacccagattttcttctcttatgccatcggcctgggggccctcacagccctaggcagctacaatcgcttcaacaacaactgctacaaggatgccatcatcctggcactcatcaacagcgggaccagcttctttgctggctttgtggtcttctccatcctgggcttcatggccacagagcagggtgtgcatatctccaaggtggcagaatcagggcctggtctagccttcattgcctacccacgggctgtcacactgatgcctgtggccccactctgggctgccttgttcttcttcatgctgctgctgctcggtctggacagccagtttgtaggtgtggagggcttcatcactgggctcctggatctcctcccggcctcctactacttccgttttcaaagggagatctccgtggccctctgttgtgccctctgctttgtcatcgatctctccatggtgactgatggcgggatgtacgtcttccagctgtttgactactactcagctagtggcactaccctgctttggcaagccttttgggagtgtgtggtggtggcttgggtttatggagctgaccgcttcatggacgatattgcctgtatgattgggtaccgaccttgcccttggatgaaatggtgctggtccttcttcaccccactggtctgcatgggcatcttcatcttcaatgttgtgtactacaagccactggtctacaacaatacctacgtgtacccatggtggggtgaagctatgggctgggcctttgcactctcttctatgctctgtgtgcccctccacctcctgggctgtctcctcagggcaaaaggaaccatggcagagcgatggcagcacctgacccagcctatctggggcctccatcacttggaatacagagctcaggatgcagatgtcaggggcctgaccaccctgactcccgtgtccgagagcagcaaggtcgtcgtggtggagagtgtcatgtgacaggcacccccagctcacatcaccagctcatcctttggtagccatagcagccccagctttagcccccacccatccctcgggggcttgcctttccttgacagtttggggatctgcctggggaaagggaggaagcaccatgagtgctaacaaaaacaactttttccatttttaataaaacgccaaaaacatcacaacccaccaaaaatagatgcctctcctccccaccccacaactacgctggtattttcgttgcttccagtccccacctcctttccttcttcccagtgcccaggacccatctcctagccttgccaagcccatctgcctgcctcccaagctctgctctgtaacacacctttgccctagaaccaacagtggcagcttggggaacaggagaggagggaaaataacagtaggacaggaggggaggcaagagagggacagtggaaccaaggtgaatatttcagctcaattagaactcttcccgcccctattctagaagctagagagccagtcagcaatggaaccttgtgttcctgcgccaattgccaccaatattaattgtgtgagcttgggtctgagtgcacgtctgtctctgtgtgatgtgtgtgtgtgtgtgtgtgtgtgtgtgtgtgtgtgtgtgtgtgtgtgtgtgtagatctcttatctcttagtgaaggtgaataccagaagtaaacagagcctctgggcaaaggaggcttatattttgcacattttataagaaaaaaaaacttgagagtgagacttctgcttgtatatttctaaaaagcccccaccatcccccatttccactcctttccttgacatccccaccttctctgaccctagccaaggagtgtgaatttatagacttaattttcataggcaaaacaaaagcttcaggctgttgaatatgtgagtctgtttgtgtggatgttctgtatggtctccagccagagactggagtaggaaggtgggagcctcaatggtgtccccacactgttcctttgcctctaagtctgtggggtagaaggctgtaacattatcccagggaatctgggtctgctcacctgacatgctcagacttgcccacacccagctccctgggctgggcatgattgcagggatttcccatggacatagcccagggaagggatcctgggtatggcttccacttccaagctaaaggctgatgtgctttcgacatctcaagtcttccgtgtagcagcttaaacccacatctgtgtcccatcaagcctgaaacagccaagtagccattagaaaggctttcttcacacagagctggactaagccagggaggtggggctgggtaagggtgcaagcctttggggacattcttactgtgctaaaaaagccactgcaaacatagcaataaaaacacttccattttccaaaaaaaaaaaaaaa

SEQ ID NO: 2010 - DNA, 1015 bp, Rattus norvegicus
  Genbank Accession No. NM_017356
cgctacacctcgctctctcctgggccggcggatccttttgtctctccaagcggtgaaggtcgcagagtcggcgcggcggttgcgggcgcactgacgcccgttctattggttatctccccagcctcagccaccgccgaacttgagctcgagaagccagcggatcgcgtccagttccggagccggggcatggtctagcagctcagtcaagcctgtgcatcatctgatccccagcagttctggtcccccttggcctctacttggctctaggtttagtctccactgccagctgccatgggcaagcagaacagcaaactgcggcctgaggtgctgcaggacctgcgggaacacacagagttcactgaccatgagctgcaggagtggtataagggcttcctcaaggactgtcccaccggccacttgacagtggacgaattcaagaagatctacgccaacttcttcccctatggcgacgcctctaagtttgccgaacacgtcttccgcacctttgacaccaacagcgatggcaccatcgacttccgggagttcatcatcgcactgagcgtgacctctcggggcaagctggagcagaagctcaagtgggccttcagcatgtacgacctggacggcaacggctacatcagccgcagtgaaatgctggagattgtgcaggccatctacaagatggtgtcctccgtgatgaagatgcccgaggatgagtccacacccgagaagcgaacagacaagatcttcaggcagatggacacaaacaatgatggcaaactgtccctggaagaattcatcaaaggtgccaagagcgacccgtccattgtccggttgctgcagtgtgaccccagcagtgctagccagttctgaggggaacgggcttttggacagttgtgagaaacacaggcttgacctgccatcttcagctttgcttgcaaaagtggattcctccgtgatctctcctgctctcccaggacctgggccaggcagcacatcacacccacccgacctg

SEQ ID NO: 2011 - DNA, 663 bp, Rattus norvegicus
  Genbank Accession No. NM_017357
tttcacttcaagccgagtccccagttcaagaaggaggtacggccgcctccttacccccatctcaggcccaccatggggaagaacaatagcaagctggcccctgaggagctggaagatctggtccagaacacggagttcagcgagcaggagctaaagcagtggtataagggtttcctgaaggactgccccagcggcatcctcaacctggaggagtttcagcaactctacatcaagttctttccttacggagacgcctccaagtttgcacagcatgctttccgcaccttcgacaagaacggcgatggcaccatcgacttccgggagttcatctgcgccctttctgtcacctcccgtggcagctttgagcagaagctcaactgggcctttgagatgtacgacctggacggtgatggacgcatcacacggctggagatgctggagatcattgaggctatctataagatggtgggcaccgtgatcatgatgcgcatgaaccaggatgggctcacgccccagcagcgcgtagacaagatcttcaagaagatggaccaggataaggatgaccagattacgctggaggagttcaaggaggcggccaagagtgacccgtccatcgtgttgctgttgcaatgtgacatgcagaagtagggctggtgaggggca

SEQ ID NO: 2012 - DNA, 991 bp, Rattus norvegicus
  Genbank Accession No. NM_017359
ggcaccggcgccgccaccgtcggggcttcctcgacgaggccgttcggaagatctcccgctccgtctcgagagctgctttctctcccgcacacgcttccccgctgctgaggccccagaacgcccgggtgaggagttggccgtagtgagcagcaccgatcccttggggctaccggcggcgagcgcccgagccgctcctcccaatggcgaagaagacgtacgacctgcttttcaagctgctcctgatcggggactcgggagtgggcaagacctgcgtcctttttcgtttttcggatgatgccttcaataccacctttatttccaccatagaaatagactttaagatcaaaacagtggaactacaaggaaagaagatcaagctacagatatgggacacagcaggccaggaacgatttcacaccatcacaacctcctactacagaggagcaatgggcatcatgctagtgtatgacatcaccaacggtaaaagttttgaaaacatcagcaagtggcttagaaacatagatcagcatgccaatgaagatgtggaaaggatgttactacggaacaagtgtgacatggaccacaagagagttgtaccgaaaggcaaaggagagcagattgcaagggagcatcgtattaggttttttgagactagtgcaaaagcaaatataaacatcgaaaaggcgttcctcacattacctgaagacatcctccgaaagacccctgtaaaagaacccaacagtgaaaacgtagatatcagcagtggaggaggtgtgacgggctggaagagcaaatgctgctgagcgctctcccgtccatctgttcccatccaccatccgtttctcttcttgctgcaaaataaaacactctgtccatttttaactctaaacagatatttttgttcctcatcttaactattcagtccacctattttatttgtctttcatctgtgactgcttgcgactattataattttcttcaacaaaaaaaa

SEQ ID NO: 2013 - DNA, 1578 bp, Rattus norvegicus
  Genbank Accession No. NM_017364
cgaaaacctagaaacaaagtatttcctgtgggcacagacattggttctgcaagagtccctcctatatataggctccagatgaaaagaaagtgaactgtgatttccccacattcctcatttctgaacatgagagaactgtaaggaagaaccattaacacaaagacagttctgtctttcagtcccttgtaaccacatctccggtcactcacataaaaatctctcatatatctggcttgactggacacttacgaattaatattgaaaagaaattgtacgtattcagtgaatgtggcaaagcgttcatccaacttcagtagatgctaggcgagaatccttgtgcgaaacagaatgttggaaagccttcagcccgagtcagagcttctgcatgatgaacctgatcctggagagaaagtttatgaatgtgatgaatgtaggaaaacctttagcctagaacaacactttgtggaacataagaaaacgcacggtggggagaagtcacccgagtgtaccggatgtggtgaagagttctcgaaagcctcttcacttactcgacatctgagaagtcgctcacggagggaatcatataagtgtggtaactgtgggagaaccttcagccagagaggaaacttcctttctcaccagaaacaacatgctgaagagagacccagtgagtctaagaaaactcccgtccccatgacaaccatcgtcagaaatcagagaaacgccgggaataaaccatatgcgtgtaaggagtgtgggaaagcctttaatggcaaatcatatctcaaagaacatgagaaaattcataccggagagaaaccatttgaatgtaatcagtgtggtagagccttcagccagaagcagtacctcattaaacaccagaacgtccacagtgggaagaagccttttaagtgtaatgagtgtggtaaggcttttagccagaaagaaaacctcattatacaccagagaatccataccggagagaagccttatgaatgtaaagggtgtgggaaggccttcattcagaaatcaagcctcatcagacaccagaggagccatactggagagaaaccgtacacatgtaaggaatgtgggaaagccttcagcggcaaatcaaacctgactgagcatgagaaaattcatattggagagaaaccctataaatgtaacgagtgtggaacaattttcaggcagaagcagtacctcatcaaacatcacaacattcacacgggcgagaagccatatgagtgcaataagtgcggaaaggccttttctcgaatcacgtcgcttattgtgcatgtgagaattcacacaggcgataagccctatgagtgtaaagtctgtgggaaagccttctgtcagagttcgtctctaaccgtgcatatgaggagccacacgggtgagaaaccgtatggctgcaatgagtgtgggaaggctttttctcagttctccactcttgctttacacatgagaatccacactggcgagaagccttatcagtgcagtgagtgtgggaaggccttcagccagaagtcccatcacatcagacaccagagaatccatattcactaaaactct

SEQ ID NO: 2014 - DNA, 1392 bp, Rattus norvegicus
  Genbank Accession No. NM_017365
ccgggatccctgcgcgccgtggtgttctgtgccttgccggtctgttccctccgattgtgcctagcaatgaccacccagcagattgttctccagggcccgggaccctggggtttccgactcgtgggcggcaaggactttgagcaacctctcgccatttcccgggtcactcccgggagcaaggctgctatagctaacttatgcataggagatttgatcacagccattgatggggaagataccagcagtatgacacacttggaagctcagaacaaaatcaagggctgcgtagacaacatgacgctcacagtatccaggtctgagcagaagatttggtctcctctagtgaccgaggaggggaaacgtcacccctacaagatgaatttagcgtcggaaccccaagaagtcctgcacatcggaagtgcccacaaccgtagtgctatgccatttaccgcctcacctgctcctggcacccgggtcatcacaaaccagtacaacagccctaccggcctctactcatctgaaaacatctctaacttcaacaatgcagtggagtcaaagacctcagccagtggggaggaggcgaacagcaggccctcggctcagcctcatccctccggcggccttatcatcgacaaggaatccgaagtttacaagatgcttcaggagaagcaagagttaaacgagccccccaaacagtccacatcattcctggttctgcaggagatcctggagtcggatgggaaaggggaccccaacaagccatcaggatttagaagtgttaaagctccagtcaccaaagtggctgcatctgttggaaatgctcagaagctgcccatctgtgacaaatgtggaaccggcattgttggtgtgtttgtgaagctgagggaccatcatccccaccctgaatgttatgtgtgcaccgactgtggcatcaacctgaaacagaagggccatttctttgtaggggatcagatttattgtgaaaagcatgcccgggagagggtcacaccacctgagggctatgatgtggtcacagtgttccccaagtgatcgagaggacctgccctgtctgctgccctccagcctgcctgctgcacctggttgtcagaatgttctggttctctcctccctgacagtcctgtgcttagtgttagtcctgctcagtaaacattgagtttctcctgtactgactgaccctgactggcagtgtgacacctgcttttacattaccgggaggtggttttgtccctgtcccctcacccacaccacaatgcaccttcttcccttggagtcttccctgctgaaaatggacattggtcacattggaattaagccaaatgttttatctctgatgttactttgttttacttaataaatttagactttaaagcc

SEQ ID NO: 2015 - DNA, 2096 bp, Rattus norvegicus
  Genbank Accession No. NM_019122
gctcgtccaccctgcaacccccatgggctaccgccccccgcctcctcggctgccacccaagacaaggcagggataagcacagtgtaggatcacgtggccactatgtctggggactacgaagatgacctctgtcggcgggccctcatcctggtttcagacctctgtgcacggatccgagatgctgataccaatgacaggtgtcaagagttcaacgaactgcgaatcagaggatatccccggggtccggatgcagacatttccgtgagcctgctgtcagtcatcgtgacgttctgtggcatcgtcctcttgggtgtctctctcttcgtgtcctggaagttgtgctgggtgccctggagggacaaagggggctcagcagtgggtggtggccccctgcgcaaagacttagcccctggggttgggctggcaggcctggtaggaggtggtgggcaccatctgggagccagcctaggtggccatcccctgctgggtggtccgcaccatcatgcacacccagcccaccatccaccatttgctgaactgctggaaccaggtggccttgggggctctgagcctccagaaccttcctacctggacatggactcatatccagaggctgctgtggcctctgtggtagctgctggggtcaaaccaagccagacatcccctgagctgccttctgagggtggaacaggctctgggctgctcctgctgcctcctagtggtgggggcttgcccagtgcccagtctcatcagcaggtcacaagtctagcacccaccaccaggtacccagccctgcctcggcccctcacccagcagaccctgaccacccaagcagacccaagcagtgaggagcgaccacctgcactgcccttacccctgccaggcggagaggagaaagccaagctcatcggtcagatcaagccagagctataccagggcactggacctggtggccggcgaacgggcgggggctctggggaggcaggggcaccctgtggccgcatcagttttgcccttcggtacctctatggctctgaccagctcgtggtgcggatccttcaggccctggatctcccagcaaaggactccaatgggttctcagacccctacgtcaagatctacctgttgcctgatcgcaaaaagaagttccagaccaaggtgcacaggaagacgctgaaccctatcttcaacgagacgtttcagttttcggtacccttggccgagctggcgcagcgcaagctgcacttcagtgtctatgacttcgacagattctcgaggcacgatctcatcggccaggtggttttggacaacctgctggagcttgctgaacagccccctgaccgtccactctggagggacatcctggagggtggctcggaaaaggcagatcttggggagctcaacttctcactctgctacctccccacggccgggctcctcaccgtgaccatcatcaaagcctctaacctcaaagcaatggacctcactggtttctcagacccctacgtgaaggcctctctgatcagcgaggggcggcgtctgaagaaacggaagacctccattaagaagaacacgctgaaccccacatacaacgaggccctggtgttcgacgtggctccggagagcgtggagaacgtgggtctcagtatcgcagtggtagactatgactgcatcggccacaatgaagtgatcggggtgtgccgcgtgggcccagaggccgctgacccacatggcagagaacactgggcagagatgctggctaaccctcgcaagcctgtggagcactggcaccagctagtggaggagaagactctaagcagctttaccaagggcggcaaaggattgtcagagaaagagaattcagagtgagggtctggtctaggcctgggattggaccaggcgccctcaggacccatcccttcctgcccggactgtgaactcatctcgaagccataatgtccgagctgctggtgcggggcggcctggacctgttcctccttatcctggaggcgtgaggctaggaggcagcaggcccagctccctgtttcagggtgggaggttctcggcctccattgtctgtcttcttatccccagag

SEQ ID NO: 2016 - DNA, 3465 bp, Rattus norvegicus
  Genbank Accession No. NM_019124
acgctgcttccccgcccatccccgttctccaggccgcccactggccatggcgcagccgggcccggctccccagcctgacgtttctcttcagcaacgggtagcagaattggaaaaaattaatgcagaatttttacgtgcacagcagcagcttgagcaagaatttaatcaaaagagagcaaaatttaaggagctgtatttggctaaagaggaggatctgaagcggcaaaatgcagtattgcaagctgcgcaggatgacttgggtcaccttcggacacagctgtgggaggcgcaggcagaaatggagaatatcaaggcgatcgccacagtctctgagaacactaagcaagaagctatagatgaagttaaaaggcagtggagagaagaagttgcttcacttcaggctgtaatgaaagagactgtgcgtgactatgagcatcagtttcacctgaggctggagcaggaacgagcgcagtgggcacagtatcgagagtctgcagaccgggagatagctgacctaagaagaaggttgtctgaaggtcaagaggaagaaaatttagaaaatgaaatgaaaaaggcccaagaggatgccgagaagcttcgctctgtcgtgatgcccatggagaaggaaattgcagccctgaaagataaactgacagaagctgaagacaagattaaagagctggaggcctcaaaggttaaggaactgaatcattatctggaggccgagaagtcttgcaggactgatctggagatgtatgtagctgttttgaacacccagaaatctgttctacaggaagatgctgagaaattgaggaaagaactgcatgaagtttgccatctcttggagcaagagcgacaacaacacaaccagttaaaacacacgtggcagaaggccaacgaccagtttttggaatctcagcgcttgctgatgagagacatgcagcgaatggagatcgtgttaacttcagaacagctacgacaagttgaagaactgaagaagaaagatcaggaggaggatgaacaacaaaggatcaataagggaaaagataacaagaaaatagacactgaagaagaagtaaaaataccagtagtatgtgctttaactcaagaagaatcttcaaccccactatcaaatgaagaggagcatttagacagcacccatgggtcagtccattccttagatgcagacttgctgttaccatctggagatccattcagtaaatcggacaatgacatgtttaaagagggactccggagagctcagtctacagacagcttgggaacctcaagctcattgcaatccaaagctttaggctataactacaaagcaaaatctgctggaaatttggatgagtcggattttggaccactggttggagcagattctgtgtctgagaactttgatactgtgtcccttgggtcactgcagatgccaagtggatttatgttaaccaaagatcaagaaagagcaattaaggcaatgacacctgaacaggaggagacagcatccctcctctcaagtgtcacacagggtatggagagtgcatatgtctctcctagtggttaccgcttagtgagtgaaacggaatggaatctcctgcagaaagaggtacataatgctggaaataagcttggtagacgttgtgatatgtgttccaattatgaaaaacagttacaaggaattcagattcaggaagctgagacaagagaccaggtgaaaaaactgcagttaatgctcaggcaagctaatgaccagctagagaagacaatgaaagagaaacaggagctagaggacttcctcaggcagagtgccgaggactcaagccaccagatatctgcacttgttttaagagcccaagcctctgaggtattacttgaagagttacaacagagtttttcccaagcaaagagggatgttcaggagcagatggcagtgctgatgcagtcacgtgaacaggtctcagaagagctggtgaggttacagaaagacaatgacagcctccagggaaagcatagcttgcatgtgtcattacaactagcagaagacttcattcttccagatactgtgcaggtgctccgggaactggttttaaaatatcgtgagaacattgttcatgtgcggacagcagcagaccacatggaagagaagctgaaggctgaaatactttttctaaaagagcaaattcaggcggaacagtgtttaaaagaaaaccttgaagagacattacagctggaaattgaaaactgcaaggaggaaatagcttccatttctagtctaaaagctgaattagaaagaataaaagttgaaaagggacagttggaatctacattaagagagaagtcgcaacaacttgagagcctccaagaaataaaagttaatttagaggaacagttaaagaaggaaactgctgctaaggccactgttgaacagctcatgtttgaagagaagaacaaagctcagaggttgcagacagaattagatgtcagtgaacaagtccagagagattttgtaaaactttctcagactcttcaggtgcagttagagaggatccggcaagcagactccctggagaggatccgggcaattctgaatgataccaaactgacagacattaaccagctccctgagacatgacaccctgatggcaggattctgacctgcattttgggtttttaactcatctttagaataacattaattattatttaactcttaatggaagaagtcacagcaaaaggaggactggagaaatgcagttctggagggagaaggctgctgtgtgcagggacagccaacagacgtttcaaagggaacactaatgagacactggactcgattccaacaggcgtgggatcagattgggtgccagaaaagtgctgtttccttgcctgcttcctccagcgtggactctggaacataattcctgccatgaaagcaacttcccaatagtgtttggaattacgttttctgttcatacaaactgggagagaaaagtttctttctcctgtggtctggggctcatcagtagcagtgttcagctagcagagaggtgtagtgcgctgtgtgagtattttatattaaaatgtggagtgagagcaggccattggctattgattgtgtttcccttgttcaatgcattttgtttcctttttaaccattccttctattggaagaccttaaatgctattgtaacttgcttgagaactataggaccatggcaaacaaaagcaattaaaattaggagaatctgaatctttggctgaggccaatatatattatatatatatcaatttatggaaaaaaagcacaaataaccttggaagcactttgtctgcacaccatgatgaacttcctgggcccaaaggtaccagggcaaataactggcaccatctaccctttcgaagtgttttagttactggatcagtggaaaataatactaataaaacaagctatctcttacatct

SEQ ID NO: 2017 - DNA, 555 bp, Rattus norvegicus
  Genbank Accession No. NM_019127
atggccaacaggtggaccctccacattgcgttcctgctgtgcttctccaccactgccctctccatcgactacaagcagctccagttccgacaaagcactagcattcggacatgtcagaagctcctgaggcagctgaatggaaggctcaacctcagctacaggacggacttcaagatccctatggaggtgatgcacccgtcacagatggagaagagttacactgcctttgccattcaagtgatgctccagaatgtctttcttgtcttcagaagcaatttctccagcactgggtggaatgagactattgttgaaagtctcttggatgaactacatcagcagacagagcttctggagataatactaaaggaaaagcaagaggaaagattgacttgggtgacatccacgactactttaggcttgaagagctattactggagggtacaaaggtaccttaaagacaagaagtacaacagctatgcctggatggtggtccgagcagaagtcttcaggaacttttccattattctaagacttaatagaaacttccagaactga

SEQ ID NO: 2018 - DNA, 1004 bp, Rattus norvegicus
  Genbank Accession No. NM_019131
cttagccgcagggggcgccggcgttgcaaagcgggcctgggcgggacgaaccggacctggctccgtaactgcaggagcccagcagtagcagctgcagagcgcggaggcagagcacagcctcagccgccgcctcgccatggcgggtagcagctcgctggaggcggtgcggagaaagatccggagcctgcaggaacaggcagatgccgcggaggagcgtgcgggcagcctgcagcgagagctggaccaggagcggaagctgcgggaaaccgctgaagctgacgtagcatctctgaacagacgcatccagctggttgaggaggagttggatcgcgctcaggagcgtctggccacagctctacagaagctggaggaggctgagaaggctgcagatgagagtgagagaggcatgaaagtcattgaaagccgagcccaaaaagatgaagaaaagatggagattcaggagatccagctgaaagaggccaagcacattgctgaagatgctgaccgaaagtatgaagaggtggcccgtaagctggtcatcatcgagagcgatctggagcgtgcggaggagagggctgagctctcggaaggcaaatgtgccgagcttgaagaagagttgaaaacggtgacgaacaacttgaagtcactggaggctcaggctgagaagtactctcagaaagaagacaagtatgaagaggagatcaaggttctctctgacaagctgaaggaggctgagacccgggctgagtttgcagagagatcagtaaccaaattggagaaaagcattgatgacttagaagataagtttctttgcttctctcctcccaagactccttcatcaagccggatgtcccacctctctgagctctgcatctgtctgctctccagctgacccaggtttctttctagtgcccacccaccctagggccaggcacagaccgtgctttctattgtacagaggtgatcctcccagtgtaaaataaacactgtacgctagtcctgtt

SEQ ID NO: 2019 - DNA, 1738 bp, Rattus norvegicus
  Genbank Accession No. NM_019132
gcagcagcagctcccgcggctcctgctctgctccgcctcggccccggagcgaggggcggagagccgcgcgcttgccttagtccgagccgccaccctccccgcgttccccgctttcccggcccgcccgaggccgcccgccccgtccccgccgccccgcagcccggccgcgccccgccgccgccatgggctgcctcggcaacagtaagaccgaggaccagcgcaacgaggagaaggcgcagcgcgaggccaacaaaaagatcgagaagcagctgcagaaggacaagcaggtctaccgggccacgcaccgcctgctgctgctgggtgctggagagtctggcaaaagcaccattgtgaagcagatgaggatcctacatgttaatgggtttaacggagagggcggcgaagaggacccgcaggctgcaaggagcaacagcgatggtgagaaggccaccaaagtgcaggacatcaaaaacaacctgaaggaggccattgaaaccattgtggccgccatgagcaacctggtgccccccgtggagctggccaaccctgagaaccagttcagagtggactacattctgagcgtgatgaacgtgccaaactttgacttcccacctgaattctatgagcatgccaaggctctgtgggaggatgagggagttcgtgcctgctacgagcgctccaacgagtaccagctgatcgactgtgcccagtacttcctggacaagattgatgtgatcaagcaggccgactacgtgccaagtgaccaggacctgcttcgctgccgcgtcctgacctctggaatctttgagaccaagttccaggtggacaaagtcaacttccacatgttcgatgtgggcggccagcgcgatgaacgccgcaagtggatccagtgcttcaatgatgtgactgccatcatcttcgtggtggccagcagcagctacaacatggtcatccgggaggacaaccagaccaaccgtctgcaggaggctctgaacctcttcaagagcatctggaacaacagatggctgcgtaccatctctgtgatcctcttcctcaacaagcaagatctgcttgctgagaaggtcctcgctgggaaatcgaagattgaggactactttccagagttcgctcgctacaccactcctgaggatgcgactcccgagcccggagaggacccacgcgtgacccgggccaagtacttcatccgggatgagtttctgagaatcagcactgctagtggagatggacgtcactactgctaccctcactttacctgcgccgtggacactgagaacatccgccgtgtcttcaacgactgccgtgacatcatccagcgcatgcatcttcgccaatacgagctgctctaagaagggaacgcccaaatttaattcagccttaagcacaattaattaagagtgaaacgcaatcgtacaagcagttgatcacccaccatagggcatgatcaacaccgcaacctttcccttttctccccagtgattctgaaaaccccctcttcccttcagcttgcttagatgttccaaatttagtaagcttaaggcggcctacagaagaaaaagaaaaagaaaaaggccacaaaagttccctctcactttcagtaaataaaataaaagcagcaacaaacagaaataaagaaataaatgaaataaatgaaactcaaaatgaaataaatattgtgttgtgcagcattaaaaaatcaaaataaaaattaaaaatgagc

SEQ ID NO: 2020 - DNA, 2145 bp, Rattus norvegicus
  Genbank Accession No. NM_019137
agcccggttgcactttggagaaaccaggagccgccgcccgaggcaggtgcgggcgagccagggcgccgcggccccccaaccctcgtccccgagccaagcgccgggagcctggagctggggcgcccggattccctgccagccacgcgcgccccagcccagcgaggccccgggcgccccgccgccaccacgccatgctccacctgagcgacttctccggccccgacgcgctcctctccaagcccaccgaaggctgcgcccacaccagccccgagctgccccggctgcctgctagggacgctccctcggccgccgcgtatcctggaggcgacttcttgagctgggctctgagcacctgcggcgccgggggggacttaacagactcctgcttcctggagggccctgcacccacgcccccttcgggcctcagctacagcggcagcttcttcatccaggcggttcccgaacacccgcacgacccggaggccctcttcaacctcatgtctggcatcttgggcttggcacccttccctagccccgaggcggcagcgtctcggtcccccctggatgtccctttccccgcgggtcccgatgccttgttgccggacctttactccccggatctgagttcggccgccttcccggaggcgttttgggaggccgcgccttcggcgggcgctccctcgcagtgcctgttcgagccccagctctccccgcccgacgtcaagcccgggctgagggcgcctcccgcttcgccagcgctggacgctgctgcttcggccttcaaagggccctacgccccctgggagctgctgtcggccggggctccggggaactgtgggtcgcagggaagcttccagaccaccccggaggcacgcttttccgccgtggggaccaaggtcgaggacctgctgtccatcagctgccccgccgagctgcccggtccggctagcagactctacccgccaggggcctacgatgccttctcgctggccccaggtgacttaggggaggggaccgagggcctcccggcgctgctgacccctccgggcggggagggagggagcggcggcgaaggcggagagttcctggccgtccctcaagcgcagctgtccccgctgggcctgcgcggcgccgccacggcagacttctccaaagccctggtggccgacctcccggggggcagcggagtggcggcgccttcatcccccgccacctccttccccgcggccaaagcccggcgcaagggacgccggggcggcaagtgcagcgcgcgctgcttctgcccgcggccgcacgtcaaggccttcgcctgccccgtggagagctgcgtgcggacgttcgcgcgctccgacgagctcaaccgccacctgcgcatccacacgggccacaagcccttccagtgccgcatctgcctgcgcaacttcagccgcagcgaccacctcaccacgcacgtgcgcacccacaccggcgagaagcccttcgcctgcgacgtgtgcggccgccgcttcgcgcgcagcgacgagaagaagcgacacagcaaggtgcacctcaagcagaaggcgcgcgccgaggagcgcctcaagggcctgggcttctactcgctgggcctctctttcgccgcgctgtagccggagctggctccgtaggtcggcgccgccggccgtcggcgcacgcgacacggtcctgccgctccctcgtccctgctgccttccctgcctcttccacgcacgtccggggccacccgcagcccagctccagttcccccgaagcgcccgccgctcacgcccttcagcacgggctccgcggacagcgcccgctgttttcggagccgccttcctctagccacccgctctggggactgtcctctcggtccacccacagagcaggcgataccttaggactgaagagagtttttgtaactggcgtacgccccacgccttcctctttatcccttcccagagtcaagctggggatgtaccgagccggtctctcaagaactttgtacagcaagtccagcaagcctttggatgtgatgtctttgctttggggttatttcctttttgttgtcgttcattttttgtaaagcagacgctactctcaagcatttgacaaaactgtttatttttgcaattaaaattattgtgc

SEQ ID NO: 2021 - DNA, 6469 bp, Rattus norvegicus
  Genbank Accession No. NM_019140
cggcccgccaggcagctccggccgtgcgcgcacgccgagccgccggagcccgggccgacccgtgccggagcagcatgcggagcccgcagccgctgctcctctggacacctcagcctgaggcctctccgtgagttacggggacaccatcccccaccagggcggaggctggaggccactgccaagcatggcgcccacctggagacccagcgtggtgtctgtggtgggtcctgtggggctcttccttgtactgctggccagagggtgcttggctgaagagccacccagatttatcagagagcccaaggatcagattggtgtgtcaggaggcgtggcctccttcgtgtgccaggccacaggtgaccctaagccacgggtgacctggaacaagaagggcaagaaagtgaactcacagcgctttgagaccattgactttgacgagagctcgggggccgtgctgaggatccagccacttcggacaccccgggatgagaacgtgtacgagtgtgtggcccagaactcggtgggggagatcacagttcatgcgaagctcaccgtcctgcgagaggaccagctgcctcctggcttccccaacattgacatgggcccccagttgaaggttgtagagcgcacacgcacagccaccatgctctgtgctgccagcggaaaccctgaccctgagatcacctggttcaaggacttcctgcctgtggaccccagtgccagcaatgggcggatcaagcagcttcggtcaggtgccctgcagattgagagcagcgaggagacagaccagggcaagtacgagtgtgtggccaccaacagcgctggggtgcgctactcatcacctgccaacctctacgtgcgagtccgccgtgtggccccccgcttctccatcctgcccatgagccacgagatcatgcccggtgggaatgtgaatatcacttgtgtggctgtgggctcacccatgccctacgtgaagtggatgcagggggcagaggacctgacgcctgaggatgacatgcccgtgggtcggaatgtcctcgaactcacggatgtcaaagactcagccaactatacttgtgtggccatgtccagcctgggagtgatcgaggccgttgctcagatcactgtaaaatctctccccaaagcccctgggactcccgtggtgacggagaacactgctaccagtatcactgtcacatgggactcaggcaatcctgaccctgtgtcctactacgtaattgagtataaatccaaaagccaggatgggccgtatcagatcaaagaagacatcaccaccacgcgctacagcatcggcggcctgagccccaactctgagtatgagatctgggtgtcagctgtcaactccatcggccagggcccccccagtgagtcggtggtgacccgcacaggcgagcaggcaccagccagtgctcccaggaatgttcaggcgcgcatgctcagtgccaccaccatgattgtgcagtgggaggagcccgtggagcccaatggcctgatccgtggctaccgcgtctactacaccatggagcccgagcatccggtgggcaactggcagaagcacaatgtggacgacagtcttctgaccactgtgggcagcctgctagaggatgagacctacactgtgagagtgctcgccttcacatcggtgggcgatgggccactgtcagaccccatccaggtcaagacccagcagggagtgcccggccagcccatgaacttgcgggctgaggccaagtcagagaccagcattgggctctcgtggagtgcaccacggcaggagagtgtcattaagtatgaactgctcttccgggagggcgaccgaggccgagaggtggggcgaaccttcgacccaaccacagcctttgtggtggaggacctcaagcccaatacggagtacgcgttccggctggcggctcgctcgccgcagggcctgggcgccttcaccgcggttgtgtgccagcgcacactgcaggccaaaccgtcagccccccctcaagacgttaagtgcaccagcttgcgctccacggccatattgatccttctggaagctttggagaaatggacggagtaccgtgtcaccgccgtggcttacacagaggtgggaccagggcccgagagctcgcccgtggtcgtccgcaccgatgaggacgtgcccagcgcgcccccgcggaaggtggaggcggaggcgctcaacgccacggctatccgagtgctgtggcgctcgcccacgcccggcaggcagcacgggcagatccgcggctaccaggtccactatgtgcgcatggagggcaccgaggcccgcgggccaccgcgcatcaaggacatcatgctggcggatgcccaggaaatggtgatcacaaacctccagcctgagactgcttactctatcacagtagccgcgtataccatgaaaggcgatggcgctcgcagcaaaccgaaggtggtggtgaccaagggagcagtgctgggccgccccaccctgtcggtgcagcagacccccgagggcagcctgctggcgcgctgggagccccccgcggacgcggctgaggacccagtgcttggctaccgcctgcagtttgggcgcgaagacgcggccccggccacgttggaactggcggcgtgggagcggcggttcgcggcgcctgcacacaagggcgccacctatgtgtttcggctggcggcgcggggccgcgcggggctgggcgaggaggcctcggcggcgctgagcatccctgaggacgctccgcgtggcttcccgcagatcctgggccccgcgggcaacgtgtccgcgggctccgtaatactgcgctggctgccacccgtgcccgccgagggcaacggcgccatcatcaagtacacggtgtccgtgcgggaggccggcaccccagggcccgcgacagagaccgaactggcggcggcggcccagccgggggccgagacagcgctcacactacaggggctgcggccggagacggcctacgagctgcgcgtgcgcgcgcacacgcgtcggggccccggccccttctcacccccgctgcgatacaggcttgcgcgggacccagtctcccccaagaacttcaaggtgaagatgatcatgaaaacttcagtgctgctaagctgggagttccctgacaactataactcacccacgccctacaagatccagtacaatggactcacactggacgtggatggccgcactaccaagaagctgatcacgcacctcaagccacacaccttctataacttcgtgctcaccaaccgtggcagcagcctgggaggcctgcagcagacggtcaccgccaggaccgccttcaacatgctcagtggcaagcctagtgtcgccccaaagcctgacaacgatggttccattgtggtctacctgcctgatggccagagtcccgtgacagtgcagaactacttcattgtgatggtcccacttcggaagtctcgtggtggccagttccctatcctactaggtagtccagaggacatggatctggaggagctcatccaggacctctcccggctgcagaggcgcagcctgcgccactcaagacagctggaggtgcctcggccttacatcgccgctcggttctccatcctgccagctgtcttccatcctgggaaccagaagcaatatggtggctttgacaacaggggcttggagccaggccaccgttatgtcctctttgtacttgctgtgctgcagaagaatgagcctacatttgcagccagtcccttctcagaccccttccaactggacaacccagacccgcagcccattgtggatggcgaggagggcctcatctgggtgatcgggcccgtgctggccgtggtcttcatcatctgcatcgtaattgccatcctgctgtacaagaacaagcctgacagcaaacgcaaggactcagagccccgcaccaaatgcttattgaacaatgcagacctcgccccccatcaccccaaggaccctgtggaaatgcgacgtatcaacttccagacgccaggtatgctcagccacccgcccattcccatcacagacatggctgaacacatggagagactcaaagccaacgacagcctcaagctctcccaggagtatgagtccatcgaccctggccagcagttcacttgggaacattcgaacctggaggccaacaagccaaagaaccgatacgccaatgtcatcgcctatgaccattcacgagtcatcctgcagcctttagaaggcatcatgggtagtgattacatcaatgccaactatgtggacggctatcggcggcagaacgcatacatcgccacgcaggggcccctgcctgagacctttggggacttctggcggatggtgtgggagcagcggtcagccactgtggtcatgatgacacggctggaggagaaatcacgggtcaaatgtgaccagtactggcctaaccgaggcaccgagacatacggcttcatccaggtcaccctactagatactatggagctggccaccttctgtgtcaggaccttttctctacacaagaatggctctagtgagaagcgtgaggtacgacattttcagttcacagcatggcctgaccacggggtacccgagtaccccacacccttcctggcgtttctgcgcagagtcaagacctgcaacccgcctgacgctggcccagttgtggtccactgcagcgcgggtgtggggcgtactggctgcttcattgtaattgatgccatgttggagcgcatcagaacagagaagacggtggatgtgtacggacacgtgacactcatgcggtcacagcgcaactacatggtgcagacagaggatcagtatagcttcatccacgaggcactgctggaggctgtgggctgtggcaataccgaggtccccgcgcgcagcctctacacctatatccagaagctggcccaggtggagcctggcgagcatgtcacaggaatggagcttgagttcaagaggcttgccagctccaaggcacacacttcgagattcatcactgccagcctgccttgcaacaagtttaagaaccgcctggtgaacatcctgccgtacgagagctcgcgtgtctgcctgcagcccattcgtggtgtcgagggctctgactacatcaatgccagcttcatcgacggctacagacagcagaaagcctacattgcaacgcagggtccactggcagagaccacagaggacttctggcgtgccctgtgggagaacaactccactattgtggtaatgctcaccaagctccgcgagatgggccgggagaagtgccaccagtactggccagctgaacgctctgcccgctaccagtactttgtggttgacccgatggcagagtataacatgccacagtacattctgcgtgagtttaaggtcacagatgcccgggatggccagtcccggaccgtccgacagttccagttcacggactggccagagcagggtgcacccaagtcaggggaaggcttcattgacttcatcggccaagtgcataagaccaaggagcagtttggccaggatggccccatctcggtgcactgtagtgctggagtgggcaggaccggagtattcatcactctgagcatcgtgctggagcgaatgcgctacgagggggtggtggacattttccagacagtgaaggtgcttcggacccagcggcctgccatggtgcagacagaggatgagtaccagttctgcttccaggcggcgttggaatacctgggcagctttgatcattatgcaacataagccatggccccgcccaacacctcgacccagctccaagtgccctgaatgtgagcccagccctcggtgctgggtgggaggcggcccagggaggaaacctcctctccctggagacaggcactgccttctgaagggcacattcctcattcccttctgactccaaaacgaggttccagggtggggggtagggtggagagtagaggagccactgctcccatagctggggtcacaagggacagaactctgctcccacacttccctgcctgcggaattccgaaaacaattctatttccaaagctacagaagagcacacagtctgacttgtaggtgggtgactgatgagaatgctgttatggtatcagacgtgtagtgtattgctaggaataagcctgtgaggatttgtactatgaggcatactcctagtagagaaccgaagtttcatcatgatgagatgtttgatgtggggtggggtgttgagggggttttttttgttcaagccaaaggtaactttattgattcatgaatctggaaagttcaagtacaggttttattccagaaaagaactgattctgagcacagtgtagtcagtgctccatcactctgggttgcccaaaaaaaagacttgcacaatgattccagttgacatgcaacatggacagaaacatttcacaaagccacacccatatatgaaggagg

SEQ ID NO: 2022 - DNA, 8329 bp, Rattus norvegicus
  Genbank Accession No. NM_019143
ctcgcacccgctgcactgcacaggggaagaaaaggagcccagggtgtgagccggccagcggccacaacttctggtcctctcccgtgtcctccttccatcttcttacaggcgtccccacctcaggacttttcctgcaggctgcgaggggaaccaacttcgtggccactagcctcctggagagggcgactctcctcccatccactcaagatgctcaggggtccgggacccgggcggctgctgctgctagcagtcctgtgcctggggacatcggtgcgctgcaccgaaaccgggaagagcaagaggcaggctcagcaaatcgtgcagcctccgtccccggtggctgtcagtcagagcaagcctggctgttttgacaacgggaagcattatcagataaatcagcagtgggaacggacctacctaggcaacgccctggtttgtacctgctatggaggaagcagaggttttaactgcgagagcaagcctgaacctgaagagacctgttttgacaaatacactggaaacacttacaaagtgggtgacacttatgagcgccctaaagattccatgatctgggactgtacctgcattggggctgggcgaggcaggatcagctgtaccattgcaaatcgctgccatgaagggggtcagtcctacaagattggtgacaagtggaggaggccacatgagactggtggctatatgttggagtgtttgtgtctggggaatggaaaaggggaatggacctgcaagccaatagctgagaaatgttttgatcacgctgctgggacttcctacgtcgtgggggagacctgggaaaagccctaccaaggctggatgatggtggactgtacttgtctgggcgaaggcaatgggcgtatcacctgcacctcccggaacagatgcaatgatcaggacaccaggacgtcctacagaattggagacacatggagcaagaaggacaacagagggaacctgctccagtgtgtctgcacaggcaacggcagaggggagtggaagtgtgagcgacatgttctacagagtgcttcagctggatctggctccttcacagatgtccgaacagctatttaccaaccccagacccacccccagcccgcaccgtacggccactgtgtcacagacagcggtgtggtctactctgtgggaatgcagtggctgaagtctcaaggagacaagcagatgctgtgcacttgcctgggcaatggcgtcagctgccaggagacagctgtgacccagacttacggtggcaactcaaacggggagccctgtgttctcccgtttcactacaacggtaggaccttctactcctgcaccaccgaagggcggcaagacggacatctgtggtgtagcacaacttcaaattatgaacaagaccagaagtattctttctgcacagaccacgcggttttggttcagactcgaggtgggaattccaatggtgccttgtgccacttccccttcctgtacagcaaccggaattacagcgactgtacttctgagggtaggcgggacaacatgaaatggtgcggcaccacccagaactacgatgccgatcagaagtttggattctgcccaatggctgcccatgaggagatctgcacgaccaacgaaggggtcatgtatcgcattggggaccagtgggataagcagcatgacctgggccacatgatgaggtgcacgtgtgttgggaacggccgtggacaatgggcctgcatcccctactcccagctccgagatcagtgcatcgttgatgacattacttacaacgtcaacgacacgttccacaagcgtcacgaggagggacatatgctgaactgtacctgcttcggtcagggccggggcagatggaaatgtgaccccatcgaccgatgccaagattcagagacccggacattttaccagattggtgactcctgggagaagtttgtgcatggtgtcagataccagtgttactgttacggccgtggcattggggagtggcactgccagcctctgcagacctacccaggcacaactggacctgttcaagtaattatcacggagacccccagccagcccaattcccaccccatccagtggaatgccccggagccttcacacatcaccaagtacattctcaggtggagacctaaaacctctacgggtcgctggaaggaagctaccattccaggccaccttaactcctataccatcaaaggcctgaccccaggtgtgatctacgagggacagctcatcagcatccagcagtacgggcaccaagaagtgactcgctttgacttcaccaccagcgccagcacacctgtgaccagcaacacagtgactggagagactgcgcccttttctcctgttgtggccacttccgaatctgtcactgaaatcacagccagcagcttcgtggtctcctgggtctcagcttccgacacggtgtcaggattccgagtggagtacgaactgagcgaggaaggagatgagcctcagtaccttgatcttccaagcacagccacttctgtgaacattcctgacctgctcccgggcagaaagtacatcgtcaacgtctatcagatatctgaagagggaaagcagagcttgatcctgtctacatcacagactacagcacctgatgcgcctccagaccctactgtggaccaggttgatgacacttccattgttgttcgatggagcagaccccaggcacctatcacagggtacaggattgtctattcaccttcagtagaaggcagtagcacagaactcaaccttcctgaaacggccaactccgtcaccctcagcgacctgcagcccggtgttcagtacaacatcactatctatgctgtggaggagaaccaggagagcacacccgttttcatccagcaggagactactggcgtcccacgatccgatgatgttcccgctccaaaggacctacagtttgtggaagtgaccgacgtgaaagtcaccatcatgtggacacctcctaatagcgcagtgactggataccgtgtggatgtcctgcctgtcaacctgccaggggaacatgggcagaggctgcctgtcaacaggaacacctttgctgaagtcaccggactgtccccaggggtcacgtacctcttcaaagtctttgctgtgcatcagggcagggaaagcaagcctctgacagcacaacagaccaccaaactcgatgctcccactaacctccagtttgtcaatgaaacggacagaacagttctggtaacttggactccacctcgagcccggatagcaggctaccgactgacagtgggcctcacccgaggaggccagcccaagcagtacaatgtgggacccatggcttccaagtatcccctgagaaatctgcagcctgggtctgagtacactgtgaccttgatggctgtgaaaggcaaccagcagagtcccaaagccaccggagtctttactaccctgcagcctctgcgctccattccaccttataacaccgaggtgacagagaccacaatcgtgatcacctggacccccgctccaaggattggcttcaagctgggtgtacgaccaagccagggaggtgaagcaccccgagaagtgacttcagactcaggaagcatcgttgtgtctggcttgactccaggcgtggaatacacgtacaccatccaagtcctgagggacggccaggagagagatgcaccaattgtcaaccgagtagtgacaccgctgtctcccccaaccaacttgcacctggaggccaatcctgacactggagtgcttaccgtctcctgggagaggagcaccaccccagatattactggctacagaataaccaccacccccacaaacgggcagcagggaaccgctttggaagaagtggttcatgccgatcagagttcctgcacttttgaaaaccgtaatcctggcctggagtacaatgtcagtgtttacactgtcaaagatgacaaggaaagtgcccctatctctgataccgtcatcccagaggtgccccagctcactgacctaagctttgttgatataactgactcaagcatcggcctgaggtggaccccgctaaactcttccaccattatcgggtaccgaatcacagtagttgcggcaggagaagggatccccatttttgaagattttgtggactcctcagtaggatactacacagttacagggctggaacccggcattgactatgacatcagcgttatcactctcattaatggcggagagagtgcccctactacactgacacagcaaacggccgtccctcctcccacggatctgcgattcaccaatatcggtccggacactatgcgggtcacttgggccccgcctccgtccattgagctaaccaacctcttggtgcgctactcacctgtgaagaacgaggaggatgtggcagagctgtccatttcaccctcagacaacgccgtggtcctaacaaatctcctgcctgggactgagtacctagtcagtgtctccagcgtgtacgaacagcatgagagcatacctctcagaggaagacagaaaacaggtctggactccccaactggttttgattcttctgatgtcaccgccaactcattcaccgtccactgggtggctcctcgggcccccatcaccggctacatcatccgccatcacgccgagcattctgccggaagacccaggcaagaccgagtgccgccctcaaggaattctatcaccctcaccaaccttaatccgggcacggagtacattgtcaccatcattgctgttaatggcagagaggagagccccccactgattggccagcaatccacggtttccgatgtcccgagagatctggaggtcatcgcttccacccccaccagcctgctcatcagttgggaaccccccgccgtctctgtgcgctattacagaatcacctatggagagacaggaggaaatagccctgtccaggaattcactgtgcccggaagcaagtccaccgccaccatcaacaacattaaaccaggagcagactacaccatcaccctgtatgctgtcactggccgtggggacagtccagccagcagcaagccagtttccatcaattatcaaacagaaattgacaagccatcccagatgcaggtgacggatgtccaggacaacagcatcagtgtcaggtggctgccttcaacttctcctgtgacaggttacagagtgaccaccgctcccaaaaatggcctaggaccaacaaaatctcaaactgtcagtccagatcaaacagaaatgaccattgaaggtttgcaacccaccgtggagtatgtggttagtgtctatgctcagaaccggaacggagaaagccagcccctggttcagactgcagtgaccaacattgaccgccctaaaggactggcattcactgatgtggatgtcgattccatcaaaattgcctgggaaagcccacaggggcaagtttccaggtacagggtgacctactcaagccctgaggatggaatccatgagcttttccctgcgcctgatggtgacgaggacacggcagagctgcacggcctcaggccgggttctgagtacacagtcagtgtggttgccttgcacggtggcatggagagccagcccctgattggagtccagtccacagccattcctgcgccaaccaatctgaagttcactcaggtgtcacccaccaccttgactgcccagtggacagcgcccagtgttaagctcactggctaccgagtgcgggtgaccccgaaggagaagacaggaccaatgaaagaaatcaacctttctccagacagcacctccgtgattgtgtcagggctcatggtggccaccaagtatgaagtcagcgtctatgctctcaaggacacattgacaagcagaccagctcagggagtcgtcacgactctggagaatgtcagccctccaagaagggcccgtgtgaccgacgctacagaaactaccatcactattagctggagaacgaagacagagacgatcactggcttccaagtcgatgccattccagccaatggccagaccccggttcagaggaccatcagcccggatgtcagaagctatactattacaggtttacagccaggcactgactacaagatccacctgtacacgctcaacgacaatgcccggagctctcctgtggtcattgatgcctccacggccattgatgccccatccaacctgcggttcctgaccaccacacccaactccttgctggtatcatggcaggcaccccgtgccaggattactggctacattatcaagtatgagaagcctggatcccctcccagagaagtggtccctcggccccgccctggtgtcacggaggccaccatcactggtctggagccaggaaccgagtacaccatctatgtcatcgcactgaagaacaatcagaagagtgagcccctgattgggaggaaaaagacagatgagcttccccaactggttacccttccacaccccaatcttcatggaccagagatcttggatgttccctccacagttcaaaagacccccttcgtcaccaaccctgggtatgacaccgaaaatggtattcagcttcctggcacatcccaccaacaacccagtgttgggcaacaaatgatctttgaggaacatggctttaggcgaaccacgccacccactgcggccacccccgtcaggcttaggccaagaccatacctgccgaatgtagatgaggaggtccaaatcggtcatgttcccaggggagacgtagactaccacctctatcctcatgttccggggctcaatccaaatgcctctacaggacaagaagctctctctcagacaaccatctcttggacgccattccaggagagttctgagtacatcatttcatgccaacctgttggcactgacgaagagcccttacagttccaagttcctggaacttctaccagtgcgactctgactggccttaccagaggggtcacctacaacatcatagtggaggccctgcacaaccagaggaggcacaaggtccgagaagaggttgttactgtaggcaacactgtcaacgaaggcctgaaccagcctacggatgactcatgctttgacccttacacggtttcccattacgccgttggagaggaatgggagcggttatctgactctggctttaagctcacttgccagtgcttgggctttggcagtggtcatttcagatgcgattcatctaaatggtgccatgacaacggtgtcaactacaagatcggagagaagtgggatcgtcagggagaaaatggccagcggatgagctgcacatgtctcgggaatggaaagggagaattcaaatgcgatccccatgaagcaacgtgttatgacgacgggaagacctaccacgtaggagaacagtggcagaaagagtatctcggagccatttgctcctgcacgtgtttcgggggccagcggggctggcgctgtgacaactgccgcagacctggggctgctgaacccagtcccgatggtaccactggccacacctacaaccagtatacacagagataccatcagagaacgaacactaatgtaaattgcccaattgaatgcttcatgccgttggacgtgcaggctgacagagatgattccagagagtaatctttccatccagcccaagccaacaagtgtctctctaccaaggtcaatccacaccccagtgatgttagcagaccctccatttctgagtggtcatttcacccttaagccttctgctctggagtcaagttctcagcttcagctcaacttacagcttctccaagcatcgccccgcgggatgttttgagacttccctcttaaatggtgacagttggtgccctgttctgcttcagggtattcagtactgctcagtattattgtctaagagaatcaaaagttcttgtgatttggtctgggatcaaagggaaacacaggtagccaaccacgatgcaatgaattgaatggtagtacccaagagcgggagcaggaagttaaaccagacagttctgctttcttttgccgtctgatctgcagcactgtcaggaggcctgtcctgtggctgtgtccaaacaccccacaggactcactgtcccaacaatcctaattgcctagaaatatctttctcttacctgttatttatcaatttttcccagtatttttatacggaaaaaattgtattgaagacactttgtatgcagttgataagaggaattcagtataattatggttggtgactatttttataatgtacatgccaacactttactactgtggaaagacaagtgttttaataaaaagatttacattccat

SEQ ID NO: 2023 - DNA, 579 bp, Rattus norvegicus
  Genbank Accession No. NM_019150
gcggccgctctccatcttgcactggatagacactccgataacctggcaggcggcaccatgaggcagaggggacgcgctacgctcctggtagcgttgctgcttctggttcagctgcgcccggagagcagccagtggagcccagcggctgcggcggcgaatgtggtccaggatccgaatctgcgatggaaccccggagtgcggaatcagggcggaggtgtccgcgcactcctcttgctgttagcggagcgcttcccgcgccgcgcgggatctgagcctgcaggcgagcggcaacgacgagacgacccgccgttgtccatcgacctcaccttccacctgctgcggaccctgctagagctagctcggacacagagccagcgcgagcgcgcagagcagaaccgcatcatattcgattcggtgggcaagtgatcggccccgtatggggtccagaaagccttgaccctttcccccacctaccccggggctggagcgcgcacaaccggagctggctcagtcccgcgttgcagcgccgcccagagttaccctgaacactctgactggatattttttaataaaactgcc

SEQ ID NO: 2024 - DNA, 2917 bp, Rattus norvegicus
  Genbank Accession No. NM_019152
cccagggaccgcagcaatctcccaaactccccttccccaggatggcagaggagttaatcacacctgtgtactgcaccggggtgtcagcccaagtgcagaagcaacgggacaaggagttgggcttgggccgccatgaaaatgccatcaagtacctgggccaggattatgaaaatcttcgtgcaagatgcctgcagaacggggtcctcttccaagacgatgccttccctccagtttctcatagcttgggcttcaaggaactgggtcccaattcctctaaaacctatggcatcaagtggaagcgtcctacggaactgctgtcaaacccccagttcatcgtggatggagccacccgaacggacatctgccagggagcactgggggactgttggctcctggctgccattgcctcgctcactctcaacgagactatcctccaccgagtggttccctacggccagagcttccaggagggctatgctggcatctttcatttccagctgtggcagtttggggagtgggtagatgtggttgtggatgatttgctacccaccaaggatggaaagctggtgttcgtgcactctgcccagggcaacgagttctggagcgctctcctggagaaagcctatgcaaaagtgaatggcagctatgaggccctttcgggaggctgcacctcagaggccttcgaggactttaccggtggggtcactgagtggtacgatctgcagaaggcacccagcgacctctaccagatcattctgaaggccctggaacgaggctccttgctgggctgctccattaatatttccgatatccgtgatttggaggctattacttttaagaacctggtgaggggccatgcatactctgtgacggatgccaagcaggtcacttaccagggccagcgggtgaacctaatccggatgcggaacccctggggtgaagtggagtggaaaggaccctggagtgacaactcctatgagtggaacaaagtggacccctatgaacgtgagcagctgagggtcaagatggaggacggggagttctggatgtccttccgggacttcatacgtgagttcaccaaactggaaatctgcaaccttacacctgacgcccttaagagcagaaccctccggaactggaataccacattttacgagggcacctggcgccggggaagcactgctggaggctgcaggaactacccagctaccttctgggtaaacccccagttcaagatccggctggaggaggtggatgacgcagacgactatgacagtcgagagtccggctgcagcttcttgttggccctcatgcagaagcatcgccgcagggagcgtcgctttggccgggacatggagaccattggttttgcagtgtaccaggtccctcgggagttggcgggtcagcctgtgcacttgaagcgtgacttcttcctggccaatgcttctcgggcacaatcagagcactttatcaaccttcgagaggtcagtaaccgcatccgcctgccgccgggggagtatatagtggtgccctccaccttcgagcccaacaaagagggtgactttctgctgcgcttcttttcagagaagaaggctgggacccaggaactagatgaccagatccaggccaacctccccgatgagaaagtgctctctgaagaggagatcgatgacaacttcaaaaccctgttcagcaagttagcaggggatgacatggagatcagtgtcaaggagttacagaccatcttgaacagaatcattagcaaacacaaagacctgcgcactaacggcttcagcctggagtcgtgccgcagcatggtgaacctcatggatcgagacggtaatgggaaactgggcctggtggagttcaacatcctgtggaaccgcatccgaaattacctgaccatcttccgcaagtttgacctggacaagtctggcagcatgagtgcttatgagatgaggatggccatcgaggctgcaggcttcaagcttaacaagaagctgcatgagctcatcatcacccgctactcagagcccgacctggccgtggactttgacaactttgtgtgctgccttgtgcgcctggagaccatgttccggtttttcaaaattctggacacagacctggatggtgttgtgacctttgatctatttaagtggttacagctgactatgtttgcatgaagcgggatggctcctctgcctgtgttcttccttcttcctctgccaagccacacctccccgccatgccgtaccagaccatgtcagctgccagtgccttccctcaaaaaaaggagggcaccttgtcctcctgtccccttgtcctcctgtcctttcacctccccactacctctgttcaattgctctaggcagagtcacagggcccttcctgcccctgtagctaaggcaaccctgacccctgctcatggctaagagcaggaaggcagctccctgcttactccttcctgcctccggggcaggagtaggcatccctgcccctcccactccctgctactgtccagatgtgtgtctcacctaatctgtggaggctctagcccctgtcatcccctagacctgcagacttcgtaaccactagctagttccttgtctgcacctgggtgttgaaggcctcacctcactatgggagccccacagccagttcaccttcctgtgccttcatgtgcagcagccaagatccctctgcaaaccaaagtacacctctcctgcccgtgtgcccaccaggaacttcctggccgggagggcactcaggccctccgtatccccaccccccttcctctattttttaatatttttcaaggaaatgcttgagggactagtgtactggttatggaggaccaggacctggggggtgggttggggaggtcccatgtttcagtgcagtgggaaaataaaatgaa

SEQ ID NO: 2025 - DNA, 2304 bp, Rattus norvegicus
  Genbank Accession No. NM_019153
ggcacgaggcgagggctctgcagtggctcccagcacccggcactgtccccggccctccgcgcagccccgttcggcccctcggaaaccaagctgcccggtcccgcgcagagcctgccttcctcaaatcacctctcctcccgcgcatcttggatatgccaggattaaaaaggatactcactgtcaccatcctggcactgtggcttccacatcctgggaatgcacagcaacagtgcaccaacggctttgacctggaccgccagacaggacagtgtttagatattgatgaatgtcggaccatccctgaggcttgccgtggggacatgatgtgtgtcaaccagaatggcgggtatctgtgcatccctcgaaccaacccagtgtatcgagggccctactccaatccctactctacatcctactcaggcccatacccagcagccgcaccaccagtgccagcttccaactaccccacgatttccaggcctcttgtctgtcgctttgggtatcagatggatgaaggcaaccagtgtgtggatgtggacgagtgtgcgacagattcacaccagtgcaaccctacccagatctgtatcaacacggaaggagggtacacctgctcctgcactgatgggtactggcttctggaagggcagtgcctagatattgatgaatgtcgctatggttactgccagcagctctgtgcgaatgttcctggatcctattcctgtacgtgtaaccctggcttcaccctcaacgatgatggaaggtcttgccaagatgtgaacgagtgtgaaactgagaacccctgtgttcagacctgcgtcaacacctatggttctttcatctgccgctgtgacccaggatatgaaccggaggaagatggcattcactgcagtgatatggatgagtgcagcttctccgagttcctctgtcaacatgagtgtgtgaaccagccgggctcatacttctgctcatgccctccaggctacgtcttgttggaagataaccgaagctgccaggatatcaatgaatgtgagcaccggaaccacacatgcactcccctgcagacttgctacaatctgcaagggggcttcaaatgtatcgaccccatcgtctgcgaggagccttatctgctgattggggataaccgctgtatgtgccctgctgagaatactggctgcagggaccagccattcaccatcttgtttcgggacatggatgtggtatcaggacgctctgttcctgctgacatcttccagatgcaagcaacgacccgataccctggcgcctattacattttccagatcaaatctgggaacgagggtcgagagttctacatgcggcaaacagggcctatcagtgccaccctggtgatgacacgccccatcaaagggcctcgggacatccagctggacttggagatgatcaccgtcaacactgtcatcaacttcagaggcagctccgtgatccgactgcggatatacgtgtcccagtatccgttctgagcctcgggttaaggcctctgacactgccttttaccagcgccgagggacaggaggagagaagaaaccagcaagaatgagagcgagacagacattgcacctttcctgctgaacatctccctggggcatcagcctagcatcctgacccctacctgtactatcgcagactgtcactctgaaggacaccatgcccccagttcctatgatgcagttatccaaaagtattctccttgacccctgatgtgaggttgcaagtgactctccaaggccttccatttatttctattttttttttttaaaaaggaaaatagattaggtttgctggggtaggagtctgtgttcaaagactgagcagcttgttcttgcctctgcccctccttcctctatctcttgctgcattgctgctttgcaaaagtcctcatgagctcatgggaaatgctgggtatagctattttgcttcttgcatgtgctgagaaggctatgggaacacgtcacagcaggatcaaaggtttttaaagagtctattttaaaatcacgtctggtattttcagcataagagaagttttagttgttcttacaatttgtatgagtgtttaaccttttctcgttcattttgagtttttaaagtgatagaattccttccagaaggcctcagatacatgttatgttcagtctttctaacctcagccttccctgcgtcttagcccagtttttatgaagacccctttaatcatgctttcttaagagtttttacccaactgggttggaagacagaggtatccggactgattaaatatttgaagaaaaa

SEQ ID NO: 2026 - DNA, 1588 bp, Rattus norvegicus
  Genbank Accession No. NM_019156
ccaggcaagacagtgagactccagaagctccgagcccagtttgccaaggccctctgctagaggcctgccatggcatctctgaggccctttttcatactagccctgctggcattggtttctctggctgaccaagagtcatgcaagggccgctgcactcagggtttcatggccagcaagaagtgtcaatgtgatgagctttgcacctactatcagagctgctgtgttgactacatggagcagtgcaagccccaagtgacccggggggatgtgtttaccatgccagaagatgagtattggagctatgactacccggaggaaaccaagaacagtaccaatgctggcgtgcaatccgagaacacctctctacactttaacctaaagcctcgagccgaagagactataaagccaacaactcctgatcctcaggaacagtcaaacacccaagaacctgaagtggggcaacagggagtggccccaaggcctgacaccactgatgaaggaacctctgagtttccagaagaagagctgtgtagtggaaagccctttgatgccttcacagacctcaagaatggttccctttttgccttccgaggtgagtattgctatgagctagatgaaacagcagtgaggcctgggtaccccaaactcatccaagatgtctggggcatcgagggccccatcgacgctgccttcactcgcatcaactgtcagggaaagacctacttgttcaagggtagtcagtactggcgctttgaggatggtgtcctggaccctgattatccccgaaacatctctgaaggcttcagtggcataccagacaacgttgacgcagccttagcccttcctgcccacagttacagtggccgggaaagggtctacttcttcaagggaaaacagtactgggagtatgaatttcagcagcagcccagccaggaggaatgtgaaggaagctctctgtcagccgtgtttgagcactttgccttgcttcagcgggacagctgggagaacatttttgaactcctcttctggggcagatcctctgatggcgccaaaggaccccaattcatcagcagggattggcatggtgtaccagggaaagtggacgctgctatggccggccgcatctacatcactggctccacattccgctctgtccaggccaaaaaacagaagtctgggcgtcgaagtcgaaaacgctaccgttcacgccgagggcgtggccatagccgcagccgcagccgcagcatgagctctcgtcgcccatcgcgttcagtctggttctctttgctctccagcgaagagagtgggctaggaacctacaattacgattatgatatgaactggctgatacctgccacctgcgagcccattcagagcgtctatttcttctctggagacaagtactaccgagttaaccttagaacacggcgagtggactctgtgaatcctccctacccacgctccattgctcagtattggctgggctgcccaacctctgagaagtaggaatcagcacccacacagctgagcttcagaaacctcgtcctccagctttttctcccagcccaataaagtgttggccccaaaa

SEQ ID NO: 2027 - DNA, 879 bp, Rattus norvegicus
  Genbank Accession No. NM_019166
cggcgcgcggtgcagccacgatggaagggggtgcgtacggagcgggcaaagccgggggcgccttcgacccctacaccctggtgcgacagccacataccatcctgcgcgtcgtgtcttgggtcttctccattgtggtcttcggctccattgtgaatgagggctacctgaacaacccggaggaggaggaggagttctgcatctacaaccgcaaccccaatgcctgcagctacggcgtgaccgtgggcgtgttggccttcctcacctgcctggtctacctggcgcttgatgtgtacttcccgcagatcagcagtgtcaaggaccgcaagaaagccgtgctgtctgacatcggtgtctcggccttctgggccttcttctggttcgtgggtttctgcttcctggccaaccagtggcaagtctccaagcccaaggacaaccctctgaacgaagggacagacgcagcccgggctgccatcgccttttcgttcttctccattttcacgtgggcgggtcaggccgtgctagccttccagcggtatcagattggcgccgactcggccctcttctcccaggactacatggatcccagccaggactccagcatgccttatgcaccctacgtggagcccagtgctgggtcggaccctactggcatgggtggcacctaccagcatccagccaacgccttcgatgctgagccccagggctaccagtcgcagggctactgagccccccctgatggtggtgacagtgaccgcctaccctgcccctgcccttacatcctagctcccctcccaagcaccctgctccctcccaggtgaccctgcctcgcacatgctcagcctccaagtgattccactgaggcccagtgcagctggggtg

SEQ ID NO: 2028 - DNA, 1018 bp, Rattus norvegicus
  Genbank Accession No. NM_019169
gtgtggagcaaagatacatctttagccatggatgtgttcatgaaaggactttcaaaggccaaggagggagttgtggctgctgctgagaaaaccaagcagggtgtggcagaggcagctgggaagacaaaagagggcgtcctctatgtaggttccaaaactaaggagggagtcgttcatggagtgacaacagtggctgagaagaccaaagagcaagtgacaaatgttggaggggcagtggtgactggtgtgacagcagtcgctcagaagacagtggagggagctgggaacattgctgctgccactggttttgtcaagaaggaccagatgggcaagggtgaagaagggtacccacaagagggaatcctggaagacatgcctgtggaccctagcagtgaggcttatgaaatgccttcagaggaaggctaccaagactatgagcctgaagcctaagaatgtcgttgcacctactgtcctaagatctgcccaggtgttcttccatggcgtacaagtgctcagttccaacgtgcccagtcatgaccttttctcaaagctgtacagtgtatttcaaagtcttccatcagcagtgatcggagtcctgtacctgcccctcagcatcccggtgctcccctctcactacagtgaatacatggtagcaggctcttgtgtgctgtggatattgttgtggcttcaaacctaaaatgttagaagaaacttaaaacacctaagtgactaccacttatttccaactcttcaccgtttttggttgctgttctcaagaagttgtgatttgctataagacttttagatgtccttaatgattctttctgtctaagaagaatgatgtgctgtgaaatttgttaatatatattttaaaatatgtgagcatgagactacgcacctataaatattaatttatgaattttacagttttgtgacgtgttttattaacttgtgtttgtatataaatggtggaaattaaaataaaataaaaacattatctcattgcaaaaaaaaaaaa

SEQ ID NO: 2029 - DNA, 1018 bp, Rattus norvegicus
  Genbank Accession No. NM_019170
cagctgcagagtttaccccaggttctttggtctccgacggcctttctacgcacacgcagccatgtcttccgacagacccgtggcactggtgactggtgctaacaaaggaatcggattcgcgatcgtacgtgatctctgtcgtaaattcttgggggacgtggtcctcacggcgcgggacgagtcacggggccacgaggcggtgaagcagctgcagaccgagggcctgagcccacgcttccaccagctggacatcgacaacccgcagagcatccgcgcgctgcgtgactttctgcttcaggagtacggaggactgaacgtgctggtcaacaatgcgggcatcgccttcaaagttgttgaccccacccccttccacattcaagcagaggtgacaatgaaaaccaacttttttggtacccaagatgtctgcaaggagctactccctataataaaaccccaaggcagagtggtgaatgtatcaagcagcgtgagtctcagggccctgaaaagctgcagcccggagctgcagcagaagtttcgaagtgagaccatcactgaggaagagctggtggggctcatgaacaagtttatagaggatgcaaagaaaggagtccatgcgaaagaaggctggcccaatagtgcatatggggtcaccaagataggggtgacagtcctgtccagaatctatgccaggaaactcaatgaggagaggagagaggacaagatcctcctgaatgcctgctgccctgggtgggtcagaaccgacatggcaggaccaaaagccaccaaaagcccagaagaaggagcagagacccccgtgtacttggcccttttgcctccaggtgcagaggggcctcacgggcagtttgttcaagataaaaaagttgaaccatggtgaatccaactctcacccccaccccttctatcctgacttggtgaaagccaagggacatttataatataccatcacttctggaaaaataaacataactaagtctttaagcacacaacaggtgtttgc

SEQ ID NO: 2030 - DNA, 1856 bp, Rattus norvegicus
  Genbank Accession No. NM_019184
gtctccctgagaaggctgccatggatccagccctagtcctggtgctcactctctcctctctgcttctcctctcactctggagacagagctttgggagagggaagctccctcctggtccaacacctctcccaatcattggaaacacccttcagatatatatgaaggacatcggccaatcaataaaaaagttttcaaaagtctacggccctatatttactctgtatttgggcatgaagccctttgtggtgttgcatgggtatgaagctgtgaaggaagctcttgttgatctaggagaggaattttctggaagaggcagttttccagtatctgaaagagttaacaagggccttggagtcatttttagcagtgggatgcaatggaaggagatccggcgtttctccatcatgaccctgaggacttttgggatgggcaagaggaccattgaggaccgtattcaagaggaggctcagtgccttgtggaggaactgaggaagagcaaaggtgccccttttgatcccacctttatcctgggctgtgctccctgcaatgtgatatgctccattattttccagaatcgccttgattataaagatccgacttttcttaacttgatgcacagatttaatgaaaacttcaggcttttcagctccccatggctacaggtctgcaatactttccctgccattattgattacttccctggaagtcataaccaagtacttaagaatttcttctatataaaaaactatgttttggagaaagtaaaagaacaccaagagtccttggacaaggacaatcctcgggacttcattgattgtttcttgaacaaaatggaacaggaaaagcacaatccgcagtctgagtttacccttgaaagcttggtggctactgtaactgacatgtttggagctggcacagaaacaacaagtaccactctgaggtatggactcctgctgctgctgaaacacgtggatgtcacagctaaagtccaggaagagatagaacgtgtaattggcagaaaccggagcccctgcatgaaagacaggagccagatgccctacacggatgctgtagtgcatgagatccagagatatattgaccttgtccccacaaacctgcctcatttagtgacacgtgatataaaattcagaaactacttcattcccaagggtaccaatgtgatagtatcgctgtcatccatactgcatgatgacaaagaatttcctaatccagagaagtttgaccctggtcactttctagatgagagaggtaactttaagaagagtgactactttatgccattctcagcaggaaagaggatatgtgcaggagaagccctggctcgcacggagctgtttttgttcttcaccaccattttacagaattttaacctgaagtctctggttgatgtaaaagacattgacacaacaccagctatcagtggatttggccatttgccccctttttacgaggcttgttttattcctgtgcaaagggcagactctctaagctctcatctgtaatgtctcttctgagggtcctgtctacttcattcttggtactatagtagctttaactcacatatccccatttccttcggatccagtgaacatcaaacctcattgagttgagttccctgagtcaatatatagttctattcctgttccctatatcttgtgacgttccctatatcttgtgacattcccatgcagtacttacatagttagtgctaatacttgtatgacttcattactgttaatactgttttcactatataaaagcaaaatattttagaatatgagaattcagagtcatctgttcccttcatgtgctaaataaatactaatttttggacc

SEQ ID NO: 2031 - DNA, 1844 bp, Rattus norvegicus
  Genbank Accession No. NM_019185
cgacttgggaggacctgttgctcttcactgacctcgatcaggccgcgaccgccagcaagctgctgtggtccagccggggcgccaagctgagtcccttcgcggccgagcagccggaggaaatgtaccagacgctcgccgctctgtccagccaggggcccgccgcttacgacggcgctcccggcggcttcgtacactccgcagctgcggcggccgcggcggccgcggcagccagctctccggtctacgtgcccaccacacgcgtgggctccatgctgcccggcctgccttacctgcagggggcgggcagcgggcccagcaatcacgcgggcggcgcgggcgcccacccgggctggccccaggcctccgccgacagccccccgtatggcgggggtggtgcagcgggcggcggcgcggccggacccggaggtgcgggatcagccacagcccacgcctctgcacgcttcccctactcgcccagcccgcccatggccaacggcgccgcgcgggaccccgggggctacgtggctgcgggcggcgcgggcgcgggtagcgtgagtggcggtggcggcagcctggcggccatgggtggccgggagcaccagtacagctcgctgtccgcagccaggccgctgaacgggacgtaccaccaccaccatcatcaccacccgacctactcgccctacatgggcgctcctctgactcccgcctggccagcgggacccttcgaaacgccggtgctccacagtttacagagccgcgcgggagctccactcccggtgccacgaggccccagcgcagacctgttggaggacctgtcggagagccgcgagtgcgtgaactgtggctccatccagacgccactgtggagacgagatggcaccggtcattacctgtgcaacgcatgcggtctctacagtaagatgaacggcctcagcaggcccctcatcaagccacagaagcgcgtgccttcatcacgacggcttggactgtcctgtgccaactgtcacaccacaaccactaccttatggcgtagaaacgctgagggtgagcccgtgtgcaatgcttgcgggctttatatgaaactccatggggtgcctcgaccacttgctatgaaaaaagaaggaattcaaaccaggaaacgaaaacctaaaaatataaataagtcgaaagcttgctccggtaacagctctgttcctatgactccaacttcctcctcctctaattcagatgactgcaccaaaaatacttctcctcccacacagtcgactgcctcaggggtgggtgcatcagtgatgtctgcagtgggagaaagtgccaaccctgagaacagtgacctcaagtattcaggtcaagatggcctctacataggtgtcagtttgtcctcccctgccgaagttacatcctcggtgcgacaggattcttggtgtgctctggccctggcctgagctggtgctgccaagggctctgaaggcctcataccacttgtgtctgattttgtccagcagtccagatggcggcaaaaaatgcagacataacattccttcgatgcgtgatttctgtgcctttgttttgaaagagatatatttcccaagaagcttattgaagtaagaagagatgggtctttgtaggaaggggcagcacagtgggcgtgtggcctattcctgtcagcctgggtctgcttccagccagcttgcctctggctctgctccacaccagtgggagaaactgtgacaatgactggggccttgtctgctaaggaagattgagagattaaaaaaaaaatagtttgtgtattgctccaaatcatgtgcttcttgtgatcaaccttggttatcccagaattc

SEQ ID NO: 2032 - DNA, 1067 bp, Rattus norvegicus
  Genbank Accession No. NM_019186
acggaggaccgtcagccagcaatcgcgtagctcgatcgatcacccaggaagagaaattgtaagcagataagaagaacgcgttcggtttgggacaccatttgcagctggaaatggggaatggactgtcagaccagacttccatcctatccagcctgccgtcctttcagtcctttcacattgttattctgggtttggactgtgctggaaagacaacagttttatacaggctgcagttcaacgaatttgtaaatactgtacctaccaaaggatttaacactgagaaaattaaggtaaccttgggcaattccaaaacagtcacttttcacttctgggatgtaggtggtcaagagaaattaagaccactgtggaagtcatatacccgatgcacagatggcattgtgtttgtggtggactctgttgatgttgagagaatggaagaagccaaaactgaacttcataaaataactaggatatcagaaaatcagggagtccctgtgcttattgttgctaacaaacaagacctgaggaactcactctctctctcagagatcgagaagttgttagcaatgggtgaactgagctcatcgactccttggcatttacagcccacctgtgcaatcataggagatgggctaaaggaaggacttgagaaactacatgatatgataattaaaagaagaaaaatgttgcggcaacagaaaaagaagagatgaatggcagtacttttatatcggtgtggaataggttttacttggtctgatttctgacaagctgaagagtgtctacagcctggtttgcctgtctgccctcacggatgctattaaagctttgttttgttgaacagtcagatacccaactctgttgccttgtggaagatgagtaaatgcaatgcttcttaaaggggtctcttctccgtgacccacaaatcttttggtactaccattttgggaagccaaaaaaggctagtaattgaccagaaaacaattttgtggaaatttgacctgaagttagtgaaataaaactttgaagagtgtaaaaaaaaaaaaaaaaaaaaaaaaaaaaaaaaa

SEQ ID NO: 2033 - DNA, 2113 bp, Rattus norvegicus
  Genbank Accession No. NM_019191
gggcagcgcggagcccgtcggaagaggaaggaacaaaaggtccggggcccggctcggacgggccgggaccaggcgctgggtgcagggtagatttaccaggctgtttctgagtgtggattgttacccttggtaagaaaatgtcgtccatcttgccattcactccgccagtggtgaagagacttctgggatggaaaaaatcagccggtgggtctggaggagcaggtggtggagaacagaatggacaggaagaaaagtggtgtgaaaaagcagtgaaaagtctggtgaaaaagctaaagaaaacaggacgattagatgagcttgagaaagccatcaccactcagaattgcaatactaagtgtgtcaccataccaagcacttgctctgaaatttggggactgagtacagcaaatacggtagatcagtgggacacaacaggcctttacagcttctctgaacaaaccaggtctcttgatggtcgtcttcaggtgtctcatcggaaagggctgccacatgttatatattgccggctgtggcgctggccagaccttcacagccatcatgagctcaaggcgatcgagaactgcgaatacgctttcagtctgaaaaaagatgaagtgtgtgtgaacccttaccactaccagagggtggagacaccagtcttgcctccagtcttggtgcctcggcacacagagattctaacagaactgccgcctctggatgactatacccactccattccagaaaacacaaatttcccagcaggaattgagccacagagtaattacatcccagaaacaccaccacctggatatatcagtgaagatggagaaactagtgaccaacagttgaaccaaagtatggacacaggctctccggctgaactgtctcctaccactctctcccctgtcaatcacagcttggatttgcagccagttacttattcagaacctgcattttggtgttcaatcgcatattatgaactaaaccagagggttggagagaccttccatgcgtcacagccctcactcactgtagacggctttacagatccatcgaactcggagaggttctgcttaggtttgctctccaacgttaacagaaacgctactgtagaaatgaccagaaggcatataggaaggggagtgcgcttgtattacataggtggggaagtgtttgccgagtgcctaagtgatagtgcgatctttgtgcagagccccaactgtaaccagagatacggctggcaccccgcgacagtgtgcaaaatcccaccaggctgtaacctgaagatcttcaacaaccaagaatttgctgctcttctggctcagtctgttaaccagggttttgaggccgtttatcagctgactcgaatgtgcaccataagaatgagcttcgtgaaggggtggggagcagaataccggaggcagacagtaacaagtactccttgctggattgaacttcatctgaatggccccctgcagtggttggacaaagtattaactcagatgggatccccgtcagtgcgatgctcaagcatgtcctaaagtccgtcagcagtggagctcattggaagacttaacgtaccaactcctccgccacagtactcgtgtgtgatcccgtggactgtgctagtcaaaacccagagcgaaaacagcacttgaggtctcatcagttaaagcaccttgtggagtctgtttcctacatttgaattttagatgggaaattagtgtctagaaatgccctcccagaggggacaaagaagacttaaagacttaatgatgtctcgttgggcataagacagtgtcccaaaggttattaataccagtagtagttgtgtacagtaacgtgtccagacccagtattgcagtgctctgctgtttgtataccttcttagtgtgcataaatgaggtgtgtgctgctgcttggtctaggcaagcctttataaaattacagtacctaatctgttattcccacttctccgttatttttgtgtcttttttaatatataatatatatatcgagattttcaaattatcatttagaagcagattttccttgtagaaactaatttttctgccttttaccaaaaataaactcgtgggggaagactcgtgcc

SEQ ID NO: 2034 - DNA, 7516 bp, Rattus norvegicus
  Genbank Accession No. NM_019196
gccgcgggctccagttccctggctacgcgtgagcgttcccgccacaccgagctcttggggccgtggttaaagcggagaggagccgagcgctctacccaccctgggagtctcctccaggccggcgagcaggagtctccttttagttggtgtttggcatcattatagtttggcatcttgaagaagatgttggaaaccatagacaaaaaccgggccctgcaggcagcagagcgcttgcaaagcaagctgaaggaacgcggggatgttgcaaatgaagacaaattgagcctcctgaagtctgtcctgcagagtccactcttcagtcagatcctgagccttcagacttctctacagcagctgaaagaccaggtaaacgttgctactttggcaactgcaaatgctgaccatgcccacacaccgcagttcagctctgccatcatctctaatctgcaaagtgagtcacttttgctgtctccaagtaatgggaacctcgaagcaatttctggacctggtgctccacctgccatggatggaaagcctgcctgtgaagaacttgatcagctcatcaaaagtatggcccagggtcgccatgtggaaatatttgagctcctcaaacctccatgtggaggcctcggcttcagtgtcgttgggctcagaagtgaaaacaggggagagctggggatttttgttcaggagattcaagagggcagtgtggctcacagagatggcagacttaaggagactgaccagatccttgccattaatggccaggtcctagatcagacgatcacacaccagcaggccatcagcatcctgcagaaggccaaagacactatacagcttgttattgccagggggtctttgccgcatatctccagcccacgaatttcccgttctccatctgcagccagcacagtttcagcccactcgaatccaactcactggcagcatgtggaaactatcgaacttgtgaatgatgggtctggtctgggatttggcatcataggaggaaaagcaactggtgtgatagtcaagacaattttgcctggaggagtagctgaccagcatggtcgactatgcagtggagaccacattctgaagattggtgacacggacctagcagggatgagcagtgagcaagtagcacaagtcctcaggcagtgtggaaacagagttaaactgatgattgccagaggcgctgtagaagaaactccagcaccttcctctttgggcatcaccctctcctcttccacatctacttcagagatgcgagttgatgcttctactcagaaaaatgaagaaagtgagacgttcgatgtggaactcactaaaaatgtccaaggattaggaattaccattgctggctatattggagataaaaaattagagccttcaggaatctttgtaaagagcattacaaagagcagtgctgtggagcttgatggaagaatccagattggagaccaaattgtagcagtcgatggcaccaaccttcagggttttaccaatcaacaagcagtagaggtgttacgtcacacgggacagacagtgcgtctgacactgatgaggaagggagccagccaggaagcagagattacgtcaagagaagacaccgcaaaagatgtggacctcccagctgaaaattatgaaaaagatgaagagtctttgtcactgaagagaagtaccagcatactgccgattgaagaggaaggatatccactgttgtcaactgagctggaagaaactgaagatgtgcagcaagaagctgccttgctgacaaagtggcagaggattatgggaattaactatgaaatagtggtggctcatgtgagcaagtttagtgagaacagtgggctgggaataagtctggaagcaacagtgggccaccacttcatccggtctgtgctaccagaaggccctgtgggacacagcgggaagctcttcagtggagatgagctattggaagtcaatggtataaatttgcttggggaaaaccatcaagatgtggtcaatattttaaaagaacttcctatcgatgtgacaatggtatgttgccgtcggactgtgccaccgaccgccctgtcagaagtggatagcctggacatacatgatcttgaactaacagagaagcctcatatagacctaggagagttcattggatcctcggagacagaggatcccatgctggcgatgtccgatgtggatcagaatgccgaggagattcagaccccgctggccatgtgggaggcaggcattcaggccatagagctggagaaagggagcaggggcctgggcttcagcatcttagactaccaggaccccatcgatccagcaaacacagtaatagtcattcgttctctggtgcctggcggcattgctgaaaaggatggacggctttttccaggagacaggctcatgtttgtcaatgacattaacctggaaaacagcactctggaagaggccgtggaagccttgaagggagcgccctcagggatggtgcgtataggagtagccaagcctttgcctctttcaccagaagaagggtatgtttctgccaaggaagacacttttctctgctcaccgcacacctgcaaggagatgggcctgtctgacaaagccctcttcagggctgacttggctctgatagatacacctgatgctgagtccgtagcagaatcaagatttgagtctcagttctctcctgataacgacagtgtctactctacacaagcctctgtcttatctcttcatgatggtgcttgtagtgatggcatgaactacggcccctctctgccctcatctcctcccaaggacgtgaccaacagttctgacctagtgctcggtctgcatttgtccctggaagaactctacacacagaacctccttcagagacagcatgctggctctcctcccacagacatgagcccagcagccacctctggtttcaccgtcagtgactacacacctgcaaatgctgttgaacaaaaatatgagtgtgcaaacacagtagcgtggactccctcgcagttgccaagtggcctaagcaccacagagctcgctcctgcactgcctgctgtggctccgaagtatttaacagagcagagctctctggtgtctgatgctgagtctgtcaccctgcagagcatgtcccaggaagcctttgagaggacggttactatagcaaaaggcagctccagtctaggcatgacagtaagtgctaataaagatggcctgggagtgattgtgcgaagcattattcacggaggcgccattagtcgggatggccgaattgctgttggtgactgcattttgtccattaatgaagaatccaccatcagtttaaccaatgcccaggcacgggccatgctgagaagacattctctaattggacctgacataaaaattacttacgtgcctgcagaacatttggaagagttcagagtaagttttggtcaacaagccggaggaataatggcactggatattttttcttcatacactggcagagatattccagaactcccagagcgagaagaaggagaaggggaagaaagtgaactgcagaatgctgcttatagcagctggagccagccccggagggtggaactttggagagagcccagcaagtccttgggcatcagcattgttggtggtcgggggatggggagccggctgagcaacggcgaggtgatgaggggcatcttcattaaacatgttcttgaagacagtccagctggcaaaaatggaactttgaagccgggagacagaatagttgaggtggatgggatggacctcagagatgcaagccatgaacaagctgtggaagccattcggaaagcaggcagccctgtagtgtttatggtacagagcattgtaaacagaccaaggaaatcccctttgccttccttgccgcacagcctttaccctaagtgcagcttcagcagcactaacccatttgcagagtctctccagctcacctctgacaaggcacccagccagtcagaatccgagtcggagaaggccacattgtgcagtgtcccttcctcctctccttcagtgttctcagaaatgagcagtgattatgcacagccatctgcaaccacagtcgcagaagatgaggacaaagaggatgagtttgggtacagctggaaaaatatccaagagcgttatggaacccttacaggccagctccatatgattgagctggagaaaggtcatagcggtttgggtctaagtcttgctgggaacaaagaccgaaccagaatgagtgtgtttatagtggggattgatcctactggagcagcagggagagatggccgactacagattgccgacgagcttttagagatcaatggccaaatattatatggcagaagtcatcagaatgcttcatcaatcattaaatgtgctccatctaaagtaaaaatcatttttatcagaaatgcagatgcagtgaatcagatggctgtatgtccaggaagtgcagcagaccctctaccttctacctcagaaagtcctcaaaataaggaggtggaaccaagtattactacatctgcttcagctgtggacctcagctcacttacaaatgtgtaccatctggagcttcccaaggatcaaggaggcttaggcattgctatctgtgaggaagacacactcaatggagtcacgatcaagagcctaactgagcgtgggggagcagccaaggatggaaggctcaaacctggggatcgcatcttggctgtagatgatgaacttgttgctggctgtcctattgaaaagttcatcagtcttctgaagacggcaaagacaactgtaaaactgactgttggagctgagaacccgggctgtcaggctgtcccttcagcagctgtcacagccagcggagaaaggaaagacagctcccagacccctgcagtcccagctccagacctggaacccattccaagtacgagcaggtcatccacaccagcaatttttgcttctgaccctgccacctgccccatcatccctggctgtgaaacaacaattgagatttccaaaggccaaacaggcctgggactgagcattgtcggggggtcagacacgttgctgggtgctattattatccatgaagtttatgaagagggagcagcatgtaaagatggaagactgtgggctggagaccagattttagaggtaaatgggattgacctgagaaaggctacacatgatgaagcaatcaatgtcctgaggcagactccgcaaagagtacggctgacgctctaccgagatgaggccccatacaaagaggaggatgtatgtgacaccttcactgtcgagctgcagaagaggccgggcaaaggccttgggttgagtattgttggcaaaagaaatgacactggagtgtttgtatcagacattgttaaaggaggcattgcagacgccgatgggagactgatgcaaggggaccagattttaatggtgaatggagaagatgtccgtaatgccacccaggaagcagttgctgccctgctcaagtgttccctaggcacagtaaccctcgaggttggaagaatcaaagccgctccattccactcagagaggaggccttctcaaagcagtcaggtgagtgagagcagcctgtcatccttcagtctcccacgttctggaatacatacatcagaatcgtcagaaagtagtgccaagaagaatgcgttagcatctgaaattcagggattaaggacagtcgaaataaaaaaggggcctgctgacgcgctgggactcagcattgccggaggagtgggcagcccgctcggcgacgtcccgatatttattgccatgatgcacccaaatggtgttgcagctcaaacccaaaaactcagagttggggataggattgtcaccatctgtggcacatccactgatgggatgactcacacacaggcggttaacttgatgaaaaatgcctcaggctccattgaagtgcaggtggttgctggaggagatgtgagtgtggtcacgggtcatcagcaagagcttgccaatccttgccttgctttcactgggctgacttccagcactatatttccggatgacttaggccctccacagtctaagaccataacactagaccgaggaccagatggcttaggcttcagcattgtaggtggctatggcagccctcatggagacttaccaatttatgttaaaacagtgttcgcaaagggagcagcggcagaagatgggcgtctaaagaggggtgatcagatcattgctgtcaacgggcaaagtctagaaggcgtgacccatgaagaagctgttgccatccttaagcggacaaagggcactgtcaccctcatggttctctcttgaattggctgtcagagccgaagcagccagctacgtgcccacctcctactgtaacggagtggaactgttcacatgacctgttgattggggaagactacgcggggccgagaaacacactgatttgttcctaacaaccaaacagcatttttcctttaccgtggcatttcatagtcttatgctcaaacagaagggaggtttgcagaggtaaacctcagttttatcttgaagatatctaacaatttatagtcatgtggacagaattattgtatgctcattttgttagtatggaaacaaaataatgcaaagttagccaagggagatggcttcagaaaaattaagataaaaggtggaaatttagaaaaaagaaggcagtcttgagtcttatagaacttccccaatctagaagtctacaaaaagaaaataaagtgcccgcagtactcttgaatagtccactgttttaaaattgtgaacattgtgatgtactggttctccttacctcttatgcgtattttttctgctaaaattgttcagcagtcttcataagctttaaaaagaaattgtgtttaatgcatatctcagtgttcttttttagttttgacctgctatattttcatgttgttgtatgtaaaataatgttgctaccctgtgttggccgcagttcttctaagaaacatccactccacgtagtcatggaagacagagaagaagcccagaaccttctaatgctgatttaacggactgatacaacgttgaaaacacgttcagtaccatgctattgtttttacattagtattaatcttaatgacatagaaaaagacaatgtgttagtaattattttggttgtatgccattagtaaattgacagaaaaattaagggggttaatgtgacttcatttcactgctgtatattaacatcttacaatacaatagtttaagtctaagggaaacagatggagctgtttaccgagcaactggtgaggaattatgtgttcaatcccattttagagcgtgaaactcctacattagaatagataaagtcactttaaatattatctatatttgtaacagaagtcgtatacatatattttattatagcattcttgtgtaaatgcagaattaaagtgaataaataagttttttgtggtgtacagcaaaaaaaaaaaaaaaaaaa

SEQ ID NO: 2035 - DNA, 2430 bp, Rattus norvegicus
  Genbank Accession No. NM_019201
acgaggcgcggctggcggcgcggtggcggctcggcacggcggtggccggtcgcaggcggccgggcggaatagcagactgcgccgaagccgccccaggcgcagggctcgcggcggcggagagcgccggactcatcggggcccgcggccacccgcgcctttcaatgggcagctcgcacttgctcaacaagggcctgccgctggtaagactttgaacccgacgcaggcttcagtggctgctgtggagcagaagcctgagagctttggttggagacaataagacgtgggatgaggctccgtgacagaacgcggttcggcctggggattctgaagacaaaaagctttggacaggcgaattcatggtcgtggaaaccccgccccaattaagcaatgtcaggcgtccgacctcccatcatgaacgggcccatgcacccccggcccctggtggcgctgctggatggccgggactgcacagtggagatgcctatcctgaaggatgtggccacagtagccttctgtgatgcgcagtccacacaggagatccatgagaaggtactgaatgaggcagtgggcgccctgatgtaccataccatcacactgaccagagaagatctggagaagtttaaagctctcagaatcatcgtccgaattggcagcgggtttgacaacatagacatcaagtcagctggtgatctaggcatcgcagtgtgcaatgtaccagcagcatctgtggaagaaacagcagactccaccctgtgccacattctgaacctataccgacgaactacctggctacaccaggcacttcgggaaggcactcgggtccagagtgtagagcagatccgagaggtggcttcaggagctgccaggatccgtggagagaccttgggcatcattggactaggtcgtgtgggccaggcggtggcacttcgggcaaaggcttttggcttcaacgtcctcttctatgacccatacctatctgatggaatcgagcgggccctggggctgcagcgtgtgagcacactgcaggacctgctcttccacagtgactgcgttaccctgcattgcggcctcaatgagcacaaccaccacctcatcaatgacttcacagtcaagcagatgagacaaggagccttcctggtgaacacagcccgtggtggcctggtggatgagaaggcactagcccaggccctgaaggaagggcggatccgtggcgcagcgctggacgtgcatgagtcagagcctttcagctttagccagggacccttaaaggatgcacccaacctcatctgcaccccccatgctgcatggtacagtgagcaggcgtccattgagatgcgagaggaggcagcccgggaaatccgacgagccatcacaggccggatcccagatagcttgaaaaactgtgtcaacaaggaccacctgacagctgccacccactgggccagcatggaccctgctgtggtgcaccctgagctcaatggggctgcctacagcaggtaccctccaggtgtggtgagtgtggcccccactggcatcccagctgctgtggaaggtattgttcccagcgccatgtccctgtcccatggcctgccccctgtggcccacccaccccacgctccttctcctggccagactgtcaagcctgaggcggatagagaccatacgactgaccagttgtagcctgtgaggagctctccagccttgacacctggtggagggagctgcacacccttggacccaagtgtgcagaggtgacatccagtgtggccctagcactccagagactggcccgggcgtgcaccaggcggggcaagaggaagcacgtccccaagttgattgtagttgtcccgtcctgtgggctggctcactgtcctgtgtcctttgcgttcctcgtttaagcaaaagaagttagtagctaattctatcacgaatgttcttgtctgtgtacagtttttagaacattaccaaggatttgtttgcttagctgtcaacaaaaagaaaacctgagggagcattcagcaagtcagtttgagattatttttccttttctacgttggaacgtgccccggaatgtggccgtcggcacacttctcaggacaatgaatccttcctgtttttctttttatgccacacagtgcattgtttttctatctgcttgtcttatttttagaataatttagaaaaacaacaaaggctgtttttcctaattttggcatgaaccccttgttccaaatgaagacggcatcgcgagtggctctgaggtgtgtctgcagtgcccagtgtgctcaggaccatcggggtctgtcctggggaaggcaggggttggcagacccttgcctacgtggtgccgtcctgctgatgtggtaggctagcaatattttggttaaaatcatgtttgtgactgtaaccatttgtatgaattattctcgt

SEQ ID NO: 2036 - DNA, 3067 bp, Rattus norvegicus
  Genbank Accession No. NM_019208
cggcaggcagtgctatcagaggaggtgcaggacttcatttcccagcaggcttcaggcggcgggcgccgcggtgccttgtgtgggatgtaagcgcggaggtgggctcgggggaccgaagccaggactctccttgggacttgcgggaggctgctttaggttcgccttttggacaggctccagagggctaggtagagattgcagggaccgggaggagtggcctttgagggtccccaagaggtctttgggacgcagcctcatcggggctgggggtcccgggattgtagggaactagaaggcccttggttgaaaggtctcagaaaccgagccgccgcccgtgtgcgcaggacgaagcggctggcgaagcagaattgtggcggagggtagagccgtagccgagcctgggagggggctctctcgccgagcccgaccctcccttcctcggcttgcccgcaggccaccgcccgccgccatggggctgaaggccgcccagaagacgctgttccctctgcgctctatcgacgacgtggtgcgcctgttcgctgcggagctgggccgagaggagcctgacctggtgctcctctccttggttctgggcttcgtagagcatttcctggctgtcaaccgtgtcatccccaccaacgtgccggagctcaccttccagcccagcccggcacccgaccctcctggtggcctcacctacttcccagtggccgacctatccatcattgctgccctctatgcccgattcaccgctcagatccgcggtgctgtggacctctccctctatcctcgagaggggggcgtttccagtcgcgaactggtaaaaaaggtctcggatgtcatatggaacagcctcagccgctcctacttcaaggaccgggcccacatccagtctctcttcagcttcatcacaggcactaaactggacagttcgggcgtggcctttgcagtggtaggggcctgccaggctctaggtctcagagatgtccatctggccctgtccgaggatcatgcctgggtggtgttcgggtccaatggggaacagacggctgaggtgacctggcatggcaaaggcaacgaggaccgcagaggccagacagtcaacgctggtgtggctgagcggagctggctgtacctgaaaggatcgtacatgcgctgtgaccgcaagatggaggtggcgttcatggtgtgtgccatcaacccttccattgatcttcacactgactctttggaactgttgcaactacagcagaagctgctctggctgctgtatgacctaggacatctggaaaggtaccccatggcgctagggaacttggcagacctggaggagctggaacccacccctggtcggccagacccgctcaccctctatcacaaggggattgcctcagctaagacctactaccaggatgaacacatctacccctacatgtacctggctggataccattgtcgcaaccgcaatgtgcgtgaagccctgcaggcctgggccgacactgccactgttatccaagactacaactactgtcgggaggatgaagagatctacaaggaattctttgaagtggccaatgacgtcatccccaacctgctgaaggaggcagccagcctgctagaagcaggcgaggagcggccaggagagcaagcccagggcacccaaggccaaggttctgccctccaggacccagagtgctttgcccacctgctgcgattctatgatggcatctgcaaatgggaggagggtagccccacaccagtactgcacgtgggctgggcaactttccttgtgcagtccctaggacgctttgagggacaggtgcggcagaaggtgcacatagttagccgggaagccgaggcagcagaggcggaagaaccatggggggacgaagcccgagaaggtcgtcggcgcggtccccgccgagagtccaagcctgaggagccaccaccacccaagaagcctgcgttggacaagggcccaggctcagggcaaagtgcagggtcgggacctcctaggaaaacgtcagggactgtctcaggtactgcccgtggcacagaagtcagcagtgctgctcaggctccagcacctgcagcatcgccacccccagagggcccagtgctcactttccagagtgagaaaatgaaaggaatgaaggagctactggtggccaccaagatcaactctagtgccatcaagctgcaactcacggcacagtcccaagtgcagatgaagaaacagaaggtgtccacacccagcgactacacactctctttcctaaagcggcagcgcaagggcctctgaactcttcgggattctgtgacaaggcccccggcctgcccacactcccatcaggcttcactctagtcctctaactcaagtctagactctgcctacagtcctaggtggcccagaactgcccagcagtgactgggagccttcatttagccccttttcgggccccagagccctggctcggttcttagaatttaggtttcatctcccaccagccagccaattggaacattgtaggtccatgcaaccggtctttacaggtccaaccccgtcccccgaaattcagtggaccatgacgggttccctagtcgagcctgaacagtccggcattcctcccacttgggggactagattgaccttagcccacaagcacagttgctacctggaaacccaggaaccaaggaccattcagtccctaggggtagatttccgcactttatagttgcatcctttggcaatccaagtcccctaccccaaagaaattaacatattgttgcctgaatctggaaatcttcctcatctccctagccccggagtccagggcatgaaggtcggactcttatctgtgaatactgagcctcgcccccttcctgaccaaactggccggagaacagagcaggacctcttccagccctctgggaacctccttgaggtcccaggaggaaatctgcacggggtgggggagggccagtcttttcctgttttgtacatagatttatttttcagttccaaggaagataaatacattttgttaagaaaaaaaaaaaaaaaaaa

SEQ ID NO: 2037 - DNA, 1134 bp, Rattus norvegicus
  Genbank Accession No. NM_019212
atgtgtgacgaggacgagaccaccgctcttgtgtgtgacaacggctctggcctggtgaaagctggctttgccggggatgatgcccccagggctgtgttcccatccatcgtgggtcggccccgtcaccagggtgtcatggtcggtatgggtcagaaggattcctacgtgggcgacgaggcccagagcaagcgaggtatcctgaccctgaagtaccccattgaacacggcattatcaccaactgggacgacatggagaagatctggcaccacaccttctacaatgagctgcgtgtggcccccgaggagcacccgaccctgctcactgaggcccctttgaaccccaaagctaaccgggagaagatgactcaaatcatgtttgagaccttcaacgtgcctgctatgtatgtggctattcaggcggtgctgtctctctatgcctccggccgaaccaccggcatcgtgttggattctggggacggtgtcacccacaacgtgcccatctatgagggttatgccctgccacacgccatcatgcgtctggacctcgctggtcgcgaccttactgactacctgatgaaaatcctcaccgagcgtggctattccttcgtgaccacagctgaacgtgagattgtgcgcgacatcaaagagaagctgtgctacgtggccctggacttcgagaatgagatggccaccgctgcctcttcctcctccctggaaaagagctatgagctgcctgacgggcaggtcatcaccatcggcaatgagcgcttccgttgcccggagacgctcttccagccttcctttatcggtatggagtctgcggggatccatgagaccacctacaacagcatcatgaagtgcgacatcgacatcaggaaggacctgtacgccaacaacgtcatgtcagggggcactaccatgtaccccggtatcgctgaccgcatgcagaaggagatcacagctctggctcccagcaccatgaagatcaagatcatcgccccccctgagcgcaagtactcagtgtggatcggcggctccatcctggcctcgctgtccaccttccagcagatgtggatcaccaagcaggagtacgacgaggccggcccctccattgtgcaccgcaaatgcttctag

SEQ ID NO: 2038 - DNA, 897 bp, Rattus norvegicus
  Genbank Accession No. NM_019213
cggcacgaggacgagagcacccgggaagagtcggcgccgctagtgccgggaccaggagcctccgcgagcaagatggccgctcccgagaccgaggccagggggcaggggtactaagtccggacccgcgtgcccttctcccggccgcctgcgccctcatcaagacctcgcgcttctagccaagacatctacatggattattctcgccgtggtcacgaggccgttccaatagagctctagttggcccagattgagaactctggcatttggctgctctgagctggaacctccgggaggtctgctgcaacaggtgcgaccctgaccgctccatgctcgtgggcgcggggaggcgtggcctcccccggggcggccacctctgttggttgctgtgcgctttcaccttaaagctctgcgaagcagaggccccggtgcgcgaggagaagctatcagtgagcacatcaacttcaccatgttggttggtagaagagtttgtggtgaccgaagagtgtactccgtgttctaacttccagattaaaacgacacctgagtgtggttctacagggtatgtggagaaaatcacatgcagctcatctaagaggaatgaattcaaaagctgccgttcagctcttctggaacaacacttattttggaagtttgaaggcatcgtggtgggggtagctttagtcttcgcttgccttgtcatcattcgtcagcgacagctggacagaaaggctcttgaaaaagtccggaagcaaattgaatccatatagctgaatctgctgtgtatggtgggtcccacggatgcatctcagatggagaaagttcagggctaatgtgccctcataagccttgtggtagtgcatcttcaatgactcctcttccaggccattaatgagcaca

SEQ ID NO: 2039 - DNA, 1356 bp, Rattus norvegicus
  Genbank Accession No. NM_019220
cccggagctgtcgatcggggacaaagcgcggccgcccgcgccccccgagccgcccgagccggggccagccccccgcgactgacatgatgtttccgcaaagccggcactcgggctcctcccacctcccccagcagctcaagttcaccacctccgactcctgcgaccgcatcaaggatgagttccagctgctacaagcgcagtaccacagcctgaagctggagtgtgacaagctggccagcgagaagtcagagatgcaaaggcattacgtcatgtactatgagatgtcttacggattgaacatcgagatgcacaaacaggctgaaattgtgaagaggctgaatgggatttgcgcccaggttctaccctatttgtcccaggagcatcagcagcaggtcctgggagctatcgagagagccaagcaggtcacggctcccgagctgaactccatcatccgacagcagctccaggctcaccagctgtcccagctccaggcgctggccctgcccctgacaccgctgcctgtcgggctccagccgccatccctccctgcggtcagcgcaggcacaggcctgctgtcactctctgctctgggctctcagacccacctctccaaggaggacaagaacggacacgatggggacacccaccaggaggatgatggagagaagtccgattagctcctggggagagggagggggaggggggataccaggggagacaggcacagagagcacagtgttctgagggccacactgcacacagctcggtccctacccaagcttccacctccagtcctggttccagctgtgcaccctgggcctaggagacgccagagggacagcccaggctacagggaaaattccccaccttcaacatttccccgggctacagccaccaatctcggcccagaatgtacacaacgctagccgcccctttccaccctgtgcaccccgaatttgccccctttccccttctctgcttcctgcactgcacacctgctaggcccagacccctccccccagctcacccagctctggttccctcaaccgcggaaagaaagcattggctcgggactgcagtgggggtgggcaccccacaaacttccctctccccttccccaaataaacgtgagggttaaaagtcggtttgtttattatttctttttcgtcccagtactctatagctaccatctaagagagaaaaagaaggaagccctggagcgagcgagggtctgtctgtgcatatagttagatttttctggtcgcctcgctttgcaccgagaggtggagggccgctgtactgagggtggggtctagctgtgccttcaaaataaaaacatgaaaaggtcaaaaaaaa

SEQ ID NO: 2040 - DNA, 1800 bp, Rattus norvegicus
  Genbank Accession No. NM_019222
  misc_feature (1)..(1800): n = a or c or g or t
ggagcggagagcggtgagcgacatgtccttccgaaaagttgtgcggcagagcaaattccggcatgtatttggtcagccagtcaagaatgaccagtgctatgaggacattcgagtctcccgagttacctgggacagtaccttctgcgcagtcaaccccaagttcctggcagtgattgtggaagccagtggtgggggtgcctttatggtgctccctctaaacaagacaggccgcattgacaaggcctacccaacagtatgtgggcacacaggacctgttctggatattgactggtgcccccacaatgacgaagtcattgccagtggatcagaggactgcactgtcatggtgtggcagattccagagaatgggctgacctcccctctgacagagccagtagtggtgcttgaggggcataccaagcgtgtgggcatcatcacctggcaccccacagcccgaaatgtgcttctcagtgcaggttgtgacaatgtggtgcttatctggaatgtgggcactgcagaggagctgtaccgcctagacagcttgcaccctgacctcatctacaatgtgagctggaaccacaacggcagcctcttttgcacagcttgcaaggacaagagtgtccgaatcatcgatcccaggcggggcaccctggtggcagaacgggagaaggctcatgagggggctcggcccatgcgggccatctttctggctgatgggaaggtgttcaccgctggtttcagccgcatgagtgaacggcaactggcactctgggacccagaaaactttgaggagcccatggccctgcaggagctggattcaagcaatggggctctactgcctttctatgacccggacaccagtgtggtctacgtctgtggcaagggtgattccagcatccggtactttgagatcacagatgaacctccctacatccactttctgaatacctttaccagcaaagaaccccagaggggtatgggcagcatgcctaagaggggcttggaggtcagcaagtgtgaaattgccaggttctacaaactgcatgaacgcaagtgtgagcccatagtaatgactgtgccaagaaagtctgacctctttcaggatgatctgtaccctgacacagccggacccgatgctgctcttgaggcagaggattgggttagtggtcaggatgctgatccaatcctcatctcactacgggaagcctatgtgcccagtaaacaacgggacctgaaggtcagccggcgcaacgtgctatcggacagcaagcctgccggttacagccgctccggagtctccacagctactgcaattactgacattcccagtggcaaccttgctgggtctggtgaagctgggaagctggaagaggtgatgcacggacttcgggcacttcgggtgctggtcaaggaacaaggggagcgtatcagccgcctggaggagcatctgggccgcatggagaatggggatacataggaccaccagggacctgctcccgatactgcctccttctcctccaacccttcccacctagcttctgtggccaggtcacaccaggcagtttgctgctcagtgcctctgtggcaggtcatggccagtttgcacctctccacagcctggggcncaggttggaagcaccacctggcttttggaagatttttgtaccaaggcaaattccaagtactctaagggaccatctcctcgacttgcccaacccactgccccctcactagaaaaagcagcagagatgggttctatattttcattccaaataaaagctctttctaaagccaaaaaaa

SEQ ID NO: 2041 - DNA, 351 bp, Rattus norvegicus
  Genbank Accession No. NM_019223
atggcggcggcgctgaccttccgccgtctgttggctctccctagggctgcccggggtttcggggtgcgagtgtcgctgagcggggagaagatcacgcataccggccaggtgtctgatggaaaagactacagggggattcgttttgtagatcgtcagaaagaggtgaatgagaactttgccattgatttgatagcacaacaacctgtgaatgaggtggaccgtcgtatcatagcctgtgatggagggggtggagccttgggccaccccaaggtgtatataaacctggacaaagaaacaaaaacgggtacgtgtgcctactgcggcctgcagttcaagcagcagcatcactag

SEQ ID NO: 2042 - DNA, 2435 bp, Rattus norvegicus
  Genbank Accession No. NM_019232
actgttggctaagccggtctcactgctcctttagtctctttggacactttccaaatatcggggcgatgaccgtcaaaaccgaggctgctcgaagtaccctcacctactccagaatgaggggaatggtagcaatcctcatcgctttcatgaaacagagaaggatgggcctgaacgattttattcagaagcttgccaacaactcctatgcatgcaaacaccctgaagttcaatcctatttgaaaatctcccaacctcaggagcccgaacttatgaacgccaacccctcacctcctccaagtccctctcaacaaatcaacctgggtccatcctcaaatccccacgccaaaccctctgacttccacttcttgaaagtgatcggaaaaggcagttttggaaaggttcttctagcaaggcacaaggcagaagaagcattctatgccgtcaaagttttgcagaagaaagccatcttgaagaagaaggaggagaagcatattatgtcagagcgcaatgttctgttgaagaatgtgaagcaccctttcctggtgggccttcacttctctttccagactgctgacaaactctacttcgtcctagactacattaatggcggagagctgttctaccatctccagagggagcgctgcttcctggaaccccgtgctcgcttctacgcagctgaaatagccagtgccttgggttatctgcactccctaaacatcgtttatcgagacttaaaaccagagaatattctcctagactcacagggacacatcgtcctcactgactttgggctctgcaaggagaacatcgagcacaatgggacaacgtccaccttctgtggcacgcctgagtatctcgctcctgaggttctccataagcagccgtacgaccggacagtggactggtggtgcctcggggctgtcttgtatgagatgctctatggcctgcctccgttctacagccggaacacagccgagatgtatgacaatattctgaacaagcctctccagctgaaaaatatcaccaactcagcaaggcacctgctggagggcctcctgcagaaggaccggaccaagaggctgggtgccaaggatgactttatggagattaagagtcatattttcttctctttgattaactgggatgatctcattaataagaagatcacgcccccatttaacccaaatgtgagcgggcccagtgaccttcggcactttgatcccgagtttactgaggagccggtccccagctccatcgggcgatcccctgacagcatccttgtcacagccagtgtgaaagaagccgcggaagccttccttggcttctcctatgcccctcctatggactccttcctctgaaagctcccaggatggttccgaaggatttcctcagcgtttttctaaagtgttttagttagcctttggtggagttaccagctgacagaacatcttagaagagaaatttgcacaccaggaagcttggcagtcccgcctgccggggcctgcacgcggcttgttgacgcggaagctttccggaagctttccgaagagcacatcctcctctcagtgagctagtgaggtcttcatttcttttcttccttccaacgtggtgctagctctaaaggagcttgagagtgccgcctgagacgcaccttggtctcagtgagaaggaagatgcaggtctaagagggatctccgcaggtctgagctgtgatcaagaatattctgcaatgtgccttttctgagattgtgttagctccaaagcttttcctatcgcagagtgtccagtttttgtttgtttttttttttttgttttgttttttgtttcttttttttcccaacccttgcgtatttcccatgtgtgcagttagtgtgagtgctatgcctgatcacagacagttttgttgtaagcatcaatgtgacacttgcaggacactacaatgtgggacattgtttgtttcttccacatttggaagataaatttatgcgcagactgtttttttttgtaagatataataactaaaacctattgaaacggtcttgcagtgacgagcatccagatgcttgagggaagcattgctgctacaaatatttctatttttagaaagggtttttatggaccaatgccccagttgtcagtcagagccgttggtgttcatgttaaaatgtcacctgcaaaatgggcattatttatggttccccccaacctttgttcattttcttttgcattcctgattattgtgtgtaaagaaagtctgtacattgggttataacactagatatttaaacttacaggcttatttgtaaaccatcattttaatgtcctgtaattaacatggttataacatgtacactcccccctactcaccacacaactttttttgtgtgcggtgaaaccaattttggtttgcaataaaatcttgaaaactatttgcg

SEQ ID NO: 2043 - DNA, 1547 bp, Rattus norvegicus
  Genbank Accession No. NM_019237
ctgctgctgctgctgctgctgctgttgctgctgctgctgtttccagcactccccctacacaatgctgcctgctgccctaacctccctgctggggccattccttctagcctgggtgctgcctcttgcccgaggccagacccccaactacacgagaccagtgttcctgtgtggaggggatgtgaccggggagtcgggttacgtggcaagtgagggtttccccaacctctaccccccaaacaagaagtgcatctggacaataacggtgcctgagggccagactgtgtccctgtccttccgagtctttgatatggaactccacccttcctgccgctatgatgctctggaggtctttgctggatccgggacctcaggccagcgacttggacgcttctgtggcaccttcaggcctgcgcctgtagttgcacctggcaaccaagtgactttaaggatgacaactgacgagggcactgggggacgaggattcctgctctggtacagcggtcgggccacctcaggcactgagcaccagttttgcggggggcggatggagaaggcgcagggaaccctgaccacgcccaactggcctgagtcggattaccccccaggcatcagctgttcctggcacatcattgcaccctcaaaccaggtgatcatgctaaccttcgggaagtttgatgtggagcctgacacatactgccgatatgactctgtcagtgtgttcaatggagctgtgagtgacgactcaaagaggctggggaaattttgcggagacaaggcccctagccccatctcttccgaagggaatgagctcctggtccagtttgtatcagatctcagtgtcactgccgatggcttctcagcctcctacaggaccctgccacgggatgccgtggaaaaggagtcagccccaagtccaggggaggatgcacagcatggtccccagtcccgctctgaccctaagacaggaactgggcccaaagtcaaaccacccagtaagcctaaagtccagcctgtagagaaacctgagggctctcctgctacccaggcaactccagttgctccagatgcccccagcatcacttgcccaaagcagtacaagcggtcaggcaccttgcagagcaacttttgctccagtagcctggtggtgacaggaacagtgaaggccatggtccggggcccaggggagggcctcactgtcaccgtcagtctcctgggtgtctacaaaaccggagacctggacctgccctctccagctagtggcacctctctgaagttctatgtgccctgcaagcagatgccccccatgaagaaaggagccagttacctgctgatgggtcaggtggaagagaacagaggccccatccttcctccggagagcttcgtggtgctctacaggcccaaccaggaccagatcctgagtaacctaagcaagagaaagtgcccctcccagcctaggccagatgcctgatgtcctcgccagatcagagtgtggtgcttttatccaaataaatgtttcttgactcaggaaggaaaaaaaaaaaaaaaaa

SEQ ID NO: 2044 - DNA, 1736 bp, Rattus norvegicus
  Genbank Accession No. NM_019242
tctcacccgcgccgctcctcgcctctcttgttagccggagactcgcctctcagccgcccgccgcacagacgcacgagtatacagtgcagctccatcggctgatccttgctgagctccaagtgtaggcggcaccgggcggcccacgatgccgaagaacaagaagcggaacgctccccaccgcggtggcgggggtggcggcggctccggggcagcgacgtcggcggccacgacaggtggcccgcatcggactgttcaacctttcagtgatgaagacgcatccattgaaacaatgagccactgcagtggctatagcgatccttccagtttcgcggaggatggaccagaagttcttgatgaggaaggaactcaggaagacttagagtacaagttgaagggattaattgacctaacccttgataagagtgcgaagacaagacaggcagctcttgaaggtgttaaaaatgcgctgtcttcaaaagtgctgtatgagtttgttctcgagagaagaatgactttaactgatagcattgagcgctgtctgaaaaaaggaaagagtgatgggcagcgcgcagctgcagcgctcgcgtccgttctttgtattcagttgggccctggattggaaagtgaagagattttaaagactcttggaccaatcctaaaaaaaataatttgtgatggaacagcgagtatccaggctaggcagacttgtgcaacttgctttggtgtttgctgttttattgccacagatgacatcactgagctgtattcaactctggagtgcttggaaggtatcttcaccaagtcctaccttaaagagaaagacacgaacgttccttgcagcactcctaatacagtgcttcacatcagctcgcttctcgcatggacgctactgctgaccatatgcccaatcagtgaagtgaagaaaaagctggagctgcatttccataaacttccaagcctcctttcttgtgatgatgtaaacatgagaattgctgctggcgaatctttggcacttctgtttgaattggccagaggaatggagagtgactttttttatgaagatatggattctttgacccagatgctccgggctctggctacagatggaaataaacaccgtgccaaagtggacaagagaaagcagcgctctgtcttcagagacgtcctgagggctgtggaggaacgggattttccaacagaaactgttaaattcggtcctgagcgcatgtatattgatagctgggtcaaaaagcacacctatgacacgtttaaagaggctcttggatcagggatgcagtaccacttgcagacaaatgaattccttcgcaatgtatttgagctggggccccctgtgatgctcgatgctgcaacacttaaaaccatgaagattcctcgttttgaaaggcatttatataactctgcagctttcaaagctcgaacaaaagcccgaagcaaatgccgagataagagagcagatgttggagaattcttctagatgtctgtctttgatgtctgttttctaatttcttcctttattattatttttgctacttctaatgtacataagcttttagagacttttttatcttggtcaacttagataatttttgatgtagggatgggttatattttaatttaatgtacagtgttacaaattaatgagttctttattctgtaaaaataactgataaccacaaataaaagtgtttgtgatgcttggtcaaaaaaaaaaaaaa

SEQ ID NO: 2045 - DNA, 5825 bp, Rattus norvegicus
  Genbank Accession No. NM_019243
cagcgcccaggaggaggaggcggagagtcgctcccgccggccgagcatggggcgcccggcgccgaggccgctgctgctggcgctcctatcgctggctgtctgccgcgggcgtgtggtgagagtccctgcgggcaccctggttcgagtggtgggcactgagctggtgatcccctgcaatgtcagtgactatgatggccccagtgagcaaaactttgactggagcttctcgtcttcgggaagcagctttgtggagctcgccagcacctgggaggtgggcttcccggcgcagcagtaccgtgagcggctgcagcggggcgacatcctgttgaggaggacagccaatgatgctgtggagctgcacataaagaatgtccagccctcggaccaaggccactacaagtgttcaactccaagcacagacgccaccgtccagggcaactatgaggacacaatgcaggttaaagtgctggcagatgccctggtggtgggccccagctcccggcctcctccaggcctgagcctgcgcgagggggagccctttgaacttcgatgtatcgcatctactacgtcaccgttgcacacacacctggcacttcggtgggaactgcaccgtggcccagtgcaccgaagcatcctagccctaagccacgagggcaggtttcacccaggacctggctatgaacagcgctaccacagtggggatgtacgcctggacacggtgggcagcgatgcctaccgcctctccgtagcccgggcactctctgcagaccagggttcctacagatgtgtggtcagtgagtggatcacagagcaaggcagctggcaagaaatccaagaaaaagctgtggaagtggccactgtggtgatccagccaacagctctgcaactggccgtgcccaggacagtgtctgtgaccgaaggaaaggacctggacctttcttgcaacatcacaacagaccgtgtggatgatgtccggcctgaggtgacatggtacttcaaaaagacacccgatacctctttgcttgcctcccatatgctggctcggctggaccgtgattccctggtacacagctcaccacacgttgctctcagccacgtggatacccgctcttaccatctactggtgcgagatgttagcaaagaaaactccggttactatctatgcctcgtggccctctgggctcctggacacaaccggagctggcacaaggtggcagaggccatgtctgccccatctggtgtaagcgtgacctggctagaaccagaataccaggtctacctgaatgcttctaaggtccccgggttttccgacgaccccacagaactgcaatgccgggtgatagacacgaagcgtgtggatgccggtgtccgacttactgtgtcgtggtactatagaatgaaccgtcgcaatgatgacgtggtggccagcgagcttctcgccgtcatggacggggactggactctgagatacggggagagaagcaaacagcgggcccaggacggcgagtttatcttttctaaggagcacacagacacattcagtttccggatccaaaggactacggaggaagacaggggcagttattactgtgttgtgtctgcctggaccaggcagaggaacagcagctgggtgaagagcaaagatgtcttctccaagcccgtcaacatattctgggcctcggaagattctgtgctcgtggtgaaggcacggcagccaaagcctttctttgctgcagggaatacatttgagatgacttgcaaagtgtcttccaagaatattaagtctccacgatactctgttctcatcacggctgagaagcctgttggggacctctccagtcccaatgaaaccaagtacatcatctccctggaccaggattccgtggtgaagctggagaactggaccgacgcatctcgggtggacggcgtcgtgttagagaaggttcaagaggatgagttccgataccgaatgtaccagactcaggtctccgatgcgggcctgtaccgctgcatggtgacagcctggtctcctatcgggggcagcttgtggcgagaggcagcgaccagtctttccaatcctattgagattgacttccaaacctcaggtcccatatttaacgcctctgtgcattcagacactctgtccgtcacccggggagatctcatcaagttgttctgtatcgtcactgtggacggagcagtgctggacccagatgacatggccttcgatgtatcctggtttgcagtacactcttttggcttggacaaggctcccatcctcctatcctccttggaccggaagggagtcgtgactacaggccagagggactggaagagtaccgtcagcctggagcgagtgagcgtgctggaatttttgctgcaagtgcatagctctgaggaccaggactttggcaactactattgttctgtgactccctgggtgaggtcaccaactggttcctggcagagggaagccgagatccactccaggcccatctttataactgtgaagatggatgtgctgaacgccttcaagtacccgctgctgatcggcgtgggcctgtccacagtcatcgggctcctgtcctgcctcattgggtactgcagttcccattggtgctgtaagaaggaggtgcgggagacgcgtcgggagcgccgcaggctcatgtccatggagatggattaagcagttggagggacagaggaacgttgtaggagcagtggggtggggggtgagaagaggactctgagattttacaaccgagtgtgttacactaaaaccggtcctctctaatctcaggtgggactcagcgctctctcttttctgcatgtcaagttccgagcgcggacatgtttaccagcacacggctcttcttcccacggcactttctgatatgtaacaatcgagtgtgtgtctccccccccccgctgaagctgtttaatggttaacccccgtctaattagttttctcctagcagcttatcgatcctctgattcacgtgtgttgatcacttttgatttaagggatcgcagtgaggaagggcgaaagcattcagagttggtcatcatgagtaagagggtacctgcccacccgaaagccagcatccacaagcagccatctggagagctgctacctgctgctctctaccctggcccagaactgatagagacctgtgccaaggcaagctgtggctatgactaccctgcccatcccccattgtcaggagtttaaactatattggaacctaaactctataacttcttgaccccataagccttttgtttccctttctcctctaccctcttctgttttcgggtttgtttctgtgagagtgaggatatggcagccctggagtctagaatttggctttccaccaagcaccttatctcgccaccttagccttaagaatgagtatgaagaaaaatccaccaccacctctgtccagggcaggtctgtgaggagaggacactggggaaggaaaggcacagatgcttgcttacttgctcactctgtagttctgaggccgctgtgcctgctccaggaatcccagggtgagtgggagcagagggcatctgagttgtgccgctgagccaggtgccctgtcccttcatgagaggcactgtcccttgtacccccaggaccagcatgggagccacaaatgtgccacattgagctccttcccaggaaggcagattgctgcctgccagactgactgacttcaaggaatcagaaattgcctggagcaagcgtgtgttctctgtgacctttttcagtccttgaagtctttttaagatccccgcagggggtggtgaagaggggtatactttgtggacggtttgctttcctattagaaacacaaagggaacccagcaatttagtgttatgtgaatggcctgtaaaataggattgaaggcagccggctctgcctgactgggcccagcaggaataggacagagggcaggcacaccttccaggtcaccagtgcctgctccatcagggcctcagccatgcaaagtctctcgccctagcatagccttccaggagcctccgataggtactgaggctcatcagccacccggtaccctcaccctaccctctacctctgaaggatttaacattgttgtcttccaaaggggagtgggggaggagagctcctttctcttaagcaataaagtaataagaaaagatggccattcacgggcagctctagtcaccatgggaccggatgcgctgagctcccccctccccaccttctctccatgtggcccatggtggcttttgtatttgccacccagtttcctctgcttgtttcgagcccaccttggagactgctcttatgatgagattctgagccggtggctctagcccaggtggggggtacaggtttagagtcggtagcaagaagagggacagcaggtgcaccccacacaagcaagagaggccagagaaagaggggaggcttcggaagacatggctgttctacatgtcgctctcttattgctagctcagacgtgaggcacaggtgactgtacaaacaggaattaggggagtagaaccaagtattaggaacttcaagcctgtgccattactggagaagattcagggcctttgcagtgcagccctccttaggaggacaagagagatttagccttggatgagttgaggtgagccctagctgtacatgaacccacagaggtccaagcgggtaactgatggtgagagatgagtgatcggtcctaccttcccctttcccttttgtctgatgttgagatttgaacctgagttgtggaggtcatgcccaaacccctccatgttgcttagggctggaagagggaccagaaaccccaggacctagttccttttgggaatattggcattctggggtatgtgtctttttaagtgtggtcaaacactcttgatgtaccaaatagtgttccccgtgaagcgctcttcctgaggctcccacccagcaacactggtctgagggaaggaaaggccaaaccaggcctgggcacatgaaattgcacttcttaaagagaaactttttagaaggttgggtatttttcttaatcacaaaaatctcccactgaaagaacctaagctacattcagatcgaagcctctaaattaaattgtttactttacaatgtttacacacatgactcacttttttagaaaaataagaaaactgcaaactccggctttttaacaacttttcagctttttcatgcatgggatagatatgctggcaacctgactcaccagctggatcaaatcctcatttagaaatgtcccgatatgtggatatatgtgtcttcccccctcccaaccacacagctccctcctgcccagacctctgtctgtttctctggtggcttttgcctcctgctttgcagaccgcctgcagccatgattttgttacggcatccacgagccaaagactgcgccttgggagcaggaacaataagcaatactacaccactcgctactgtcgggggtctttttctctttcttttcttttttagcttcactgatggcaacagaggaagaaaggaattgaggtttaggcaagttctcttcccctgtgtgaccagattctcggtgacacacagttgtgcagatcactaggagaacaaggttgggttttcttttctagtgtgtaacacaaggatctgcaggattttccgtagacaaagaggtctcgtgtatttttgtccctatccaaggttatacaaactaattgtgttgttttatactgtggccacaaatattatgcaatgcaccatttgtttttgtttttattttattaaaggaaatttaattta

SEQ ID NO: 2046 - DNA, 1253 bp, Rattus norvegicus
  Genbank Accession No. NM_019247
gaattcgggcccccagccaccaccgggagtctgcctgctgcgggacacactagccctccctccatggagtttgggctgcttggtgaggcagaggctcgaagccctgcgctgtcattgtcagatgcaggcactccacaccctccgcttccagaacatggctgcaaggggcaggagcacagtgactcggagaaggcctcggcctcactgccggggggctcccctgaggatggctccctgaagaagaagcagcggcggcagcgcacgcacttcaccagccagcagctgcaggagctggaggccaccttccagaggaatcgctaccccgacatgagcacgcgcgaagagatcgccgtgtggaccaacctcactgaggcccgcgtgcgggtgtggttcaagaaccggcgcgccaagtggcggaagcgggagcgcagccagcaggcggagctgtgcaagggcggcttcgcagccccgctcgggggcctggtgccaccctacgaggaggtgtacccgggctacacgtacggcaactggccgcccaaggcgctcgccccgccgctcgccgccaagaccttcccgttcgccttcaactcggtcaacgtggggcctctagcttcacaacctgtattctcaccgcccagctccatcgctgcctccatggtgccctcggcggccgctgccccgggcaccgtcccaggtcccggagccttgcagggcctgggcggggcaccccccgggctggctccagccgccgtgtcctccggggcagtgtcctgcccttacgcctcggccgccgcagccgccgctgcagccgcctcctccccttatgtataccgggacccgtgtaactcgagcctggctagcctgcggctcaaagccaagcagcacgcctctttcagctaccccgccgtgcccgggccgccgccggccgctaaccttagtccctgccagtacgccgtggaacggccagtgtgaaccgcaggtctgtggatccatccccgagggcggggcagtaattcacagcctctctggacaggggtcgcctagactggcttgcccttcgtcccagggtctgaaaaggggtgccagagcacccgggaagaggcggctccgaagagggccttttccctcacagcccctgaggggtggtctgacccctatacggagaccgcggccctgggactaaggccaggaacagggaccagctcccccggggccaattcacccttggctcaccccgccttctccccgaattc

SEQ ID NO: 2047 - DNA, 2682 bp, Rattus norvegicus
  Genbank Accession No. NM_019248
acccccctctcctctcctcctcctcctcttttttagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctctttcccctcctggaagggcaggattcagggaacagcaatgggaacgccagcatcaacatcacggacatctcaaggaatatcacttccatacacatagagaactggcggggcctgcacacactcaatgctgtggatatggagctctacacgggactccagaagctgaccatcaagaattctggactccggaatattcagcccagagcctttgctaagaatccccacttgcgttatataaacttgtcaagtaaccggctcaccacactctcctggcagctcttccagacgctgagtcttcgggaattgagactggagcagaacttcttcaactgcagctgtgacatccgctggatgcagctgtggcaggaacagggggaggcacggctggacagccagagcctctactgcatcagtgctgatggctcccaactccccctcttccgcatgaacatcagtcagtgtgatctccctgagatcagtgtgagtcacgtgaacctgactgtccgagaaggagacaatgctgtaatcacttgtaatggctctggctctcctttgcctgatgtggactggatagtcaccggactgcagtccatcaatactcatcagaccaatctgaactggaccaatgtacatgccatcaacttgaccctggtgaatgtgacgagcgaagacaatggtttcaccctgacgtgcattgcagagaacgtggtgggcatgagcaatgccagcgttgctctcactgtctactaccctccacgtgtggtgagcttggtggagcctgaggtacgcctggaacattgcattgagtttgtggtgcgtggcaacccgacacccacgctgcattggctgtacaatggacagccactgagggaatccaagatcattcatatggactactaccaggagggtgaagtctcagagggctgcctgctcttcaacaagcccacccactacaacaatggcaactacaccctcattgctaagaatgccctgggcacagccaaccagaccatcaacggccacttccttaaggagccctttccagagagcacagatttctttgactttgagtctgatgcgagccctacacctcctatcactgtgacccacaaaccagaggaagacacttttggggtgtccatagcagttggacttgctgcttttgcctgcgtccttctggtggtcctctttatcatgatcaacaagtacggtcgacggtccaaatttggaatgaagggtcctgtggctgttatcagtggggaggaggactcagccagcccactgcaccatatcaaccatggcatcactacaccttcatcgctggatgctgggccggatacagtggtcattggcatgactcgaattccagtcattgagaacccccaatatttccgtcagggacacaattgccacaagccagacacatatgttcaacacatcaagaggagagacatcgtgttgaagagagaactgggtgagggagcctttggaaaggtcttcctggctgagtgctacaatctaagccccaccaaagacaagatgcttgtggcagtgaaggccctgaaggatcccaccttggctgccaggaaggatttccagagggaggccgagctgctcactaacctgcagcatgagcatattgtcaaattctatggggtctgtggtgatggggatccactcatcatggtctttgaatacatgaagcatggagacctgaacaagttcctcagggcccatgggccagatgcgatgatccttgtggatggacagccacgccaggccaagggggagctaggactctcccagatgctccacatcgccagtcagatagcctccggcatggtgtacttggcctcccagcactttgtgcaccgggacctggccaccaggaactgcctagttggagccaaccttctagtgaagattggagattttggcatgtccagggacgtctacagtactgattactacagggtgggaggacacaccatgctccccatccgctggatgccacctgaaagcatcatgtaccggaagtttaccacagagagtgatgtgtggagctttggggttattctttgggagatctttacctatgggaagcaaccatggttccagctctctaacacagaggtcattgaatgcatcacccaaggccgtgtcttggagagaccccgagtctgcccaaaagaagtatatgatgtcatgctggggtgctggcagagggaaccacaacagcgactgaatattaaggagatctacaaaatcctccatgctttggggaaggccaccccaatctacctggacattcttggctagtggtgactggtggccaagcgtttatactctgttgcctcctctctccctgcctcatctcctctttttcctcacctcaactcctttcgtccatctttgaccgaaacgaacatcttcatataaactcaagtgcctgctacacatacaacactgaat

SEQ ID NO: 2048 - DNA, 3665 bp, Rattus norvegicus
  Genbank Accession No. NM_019250
ccaccaggcctaacaactagaggaggcttacggccctcggaaaccacgcccccatcagtcagtccccaccctcagctgacatcagcgagtccggccctgggcgcagagcgcaggcagcgcggagccgcgccggccggccctgcgcccacgccgccccgggtctcgcggcccgccggccacccgcgccaccgggagtcgtccatggtgcagcgcatgtgggccgaggcgtccgggcccatagggggcgccgagccgttgtttcccggctcccggcgcagccgcagcgtgtgggacgccgtgcgtctggaggtgggcgtccctgacagctgtccagtggtgctgcacagcttcacgcagctcgaccccgatctgccgcgcctggagagctctacgcaggagattggggaggagctgatcaacggggtcatctactccatctccctgcgcaaggttcagctatacccaggagccaccaagggccagcgctggctagggtgcgagaatgagtcagctctgaacctctacgagacttgcaaggtgcgcacggtgaaggccggtactctggagaagctggtggaacacctggtgcctgccttccagggcagtgacctttcctacgtcaccgtattcctgtgcacctacagagccttcacaaccactcagcaggtgctagacctgctgttcaaaagatatggctgcatccttccctactccagtgaggacggcggaccacaggaccaactcaaaaatgccatctcttccatcctgggcacctggctggaccaatactccgaggacttctgtcaacccccggactttccctgcctcaagcagctggtggcttatgtgcagctcaacatgcctggctcagacctggagcgccgtgctcaccttctcctggcccagctggaggacctggagcccagtgaggttgagcctgaggccctgtccccagctccagtgctgtctctgaaaccagcttcacagctagaaccagctcccgccctgcttctgacgcccagccgagctgtggcatccactccagtacgagagccagccccggtgccagtactggcatccagcccggtggtggcgccagcctctgagctagaaccagctctggagccgcccctagaccctgagccaaccctcgcacctgctccagagctggaccccactgtctcacagagcctccacctcgagcccgctcccgtgcccgctcctgcattagagccttcctggcctctgcctgaaaccacggagaacggactgtgtgcaaagcctcacctactgctgttccctccagacttggtggctgaacagtttacgctgatggacgcagagctattcaagaaagttgtgccctaccactgcctgggctccatctggtcccagcgggcaaagaagggcaaggagcacctcgcgcccaccatccgtgccactgtcgcccagttcaacaacgtggccaactgtgtcatcaccacctgccttggggaccagagtatgaaagcttcggacagggcccgggtggtggaacactggatcgaggtggccagggagtgcagggtgctcaagaatttctcctccctctacgccatcctctctgccctacagagcaatgccatccaccgcctaaagaagacatgggaagaggtctccaggggcagctttcgagtgttccagaaactgtcagaaatcttctctgatgagaacaactactccttgagcagagagctgctcatcaaggaaggaacctccaagtttgccacgctggagatgaaccctaggagaacccagaggcggcagaaggagacaggtgtcatccagggcactgtcccctacctgggcacattcctcactgacctggtgatgctggacacagccatgaaggactatctatatgggagactgatcaactttgaaaagaggaggaaggagttcgaagtcatcgcccagatcaagttgctccagtcggcctgcaacaactacagcattgttcccgaggagcactttggagcctggttccgagccatgggacggctcagcgaggctgagagctacaacctgtcgtgtgagctggagcccccgtctgagtcagccagcaacaccctgaggagcaagaaaagcacagctatcgtcaagcgctgggagcgacgccaggctcccagcacggagctcagcaccagtagcagtgcacactccaagtcatgtgaccagctccggtgcagcccctacctcagcagcggggacatcacggacgcactcagtgtgcactcagctggttcatccacgtctgacgtggaggagatcaacatgagctttgttccagagtctcctgatggccaggaaaagaagttctgggagtcagcctcccagtcgtccccagagacctctggcatcagctcggcctccagcagcacctcctcttcgtcagcctctaccacaccggtgtctaccacacgcacccacaagcgctctgtctcaggggtctgcagctacagctcctcactgccactctacaaccagcaggtgggcgactgctgcatcatcagggtcagcctggatgtggacaacggcaacatgtacaagagcatcctggtgaccagccaggataaggctccgactgtcatccggaaagccatggacaaacacaacctagatgaggacgagcccgaggactatgagctgctgcagatcatctcagaggaccacaagctgaaaattccagagaacgccaatgtgttctatgccatgaactctgccgccaactatgacttcatcctaaagaagcgggccttcactaagggggctaaagtcaagcatggagccagctccactctccctcgaatgaagcagaagggactcaggattgccagaggcatcttctaaggacgtctcccaggggctggctggctggctggggactaagcacttacagactagagtggcccaggccacaggtacctctgccctcctgccagcccaggctactcccagactccactttcaccccgaacctgtcctgctgccgggattgacacctgccactgacaggctgacctggcctccggggaccgctcaccgccttaggtgccttctgctctctgcaaccagaggactagctgactttgccaaggggtgctgccagctgggcatggagcctcgcctgccctggacaatgtccaccacactttcctgtcacctccccaagtgcagatcactgccacccatgctcccagatgctccaggacacccacacacccagcggggctgccaactgcgttctctccttgtgcccataggccatggcctgggaccttcatggaggtcctagcctttcttaggctgcaccaaagattccaccttcaggcctacagagtgagggagtctcgcccaccacgagcccaagccctcccatggatcagagagagaagccctctcatggaccgcctggttggcattgaaccccataccactgaaagtgccattcaccaccgctgcgtcccgggtgtacaagactacatgcaatgggaggtttgtggggagggggaagacgactggatatttgtataaaacgtaaaaagtttactgattggggtggggcaatatttatttgttgtaaatagaaaatgctagacttgaatattatattaaaatcccgtttc

SEQ ID NO: 2049 - DNA, 2781 bp, Rattus norvegicus
  Genbank Accession No. NM_019257
cgtggatttcacacaggatagcaattacctgttgactggaggacaggacaaactgctgcgcatatacgacttgaacaaacctgaagcagaacgaggagttgagttcgtgtgtgtagggaggcagacagctccgacgcagactacggacctctccaggtctcagccgtcaaagaccctgtccggtaggaaacactagccggggatcatgagtggctgtcgagtgttcattgggagactaaatcccgcagcgagggagaaagatgtggaaagattcttcaagggttacggacggatcagagatattgatttgaaaagaggttttggttttgtggaatttgaggacccaagggatgcagatgacgctgtttatgaacttgatgggaaggaactttgcagtgaaagggttactatggaacatgctcgggctcggtctcgaggtggaagaggtagaggacgatactccgaccgttttagcagtcgcagacctcgaaatgatagacgaaatgctccacctgtaagaacagaaaatcgacttatagttgagaatttatcctcaagagtcagctggcaggtttgttgaaatacagttttgatattttaatgtggcatttaagaatgttaatgggtagttaatgttttattaatatatcttaaattattgctttatcttaaattaatggatttaattcaattataattttaaactttagttaaatgtaactgggggatgtttcagattttaatattagtgatcaaatgtaaatgttttgaggttattttttcatgttttttaaaatcaattttaaccaaatattaaaccctttatttgccagcctatctgtgtcgttggccttatgacgaggagtgcctgtgggttatcctaatcgttgtcttggtcactcttggttgggcctggttgactttgccagtcagctcctacagtgatcagttggccacctctagagatctgtgtttgccggtctagacgtaatcggtgcacttacttgaagtgccgggttgcagcgattccagaacgttgataacgtgatctgatccctaagttgagagctgtcttcctgtaacgcttccgaataagaggtcctggtcgaaagagttgaaagatacgaaattagttggtcgttggaatcctgatcgcagtaaagtggtccttggtaactgcacacgagtaaaacatgtctgcatcgccagtagtctgctaatagggagggctgtgcgattaaaggcttccatcgattgggtagtatccttcaagtgggtggcgaagagccagtcgggcctatgtcatgaaggtttctccgaccgcttaatggtttgctgcttgactgagcctagggaaatgttaataaaggtaaagtaaatttttttaatgacatatggggcacaaaataactggtgtctttgtaaatgttgttttacttttttttttgtttttgttttttttaaatataagactagtctttaaaagatgtactgttcctttttgtttttttgttgtttgttttgtttttttgtttgtttttccccctttttgtactgagctcagttagactaatactataatgttaaaaactggaatttcctctagcattttgcttaaaagcaatatgctatttgcttatttcgtgccctggcatactttttgaattccgatagaatacaagtgtggtatatgccatgtttgtactatctaacaacttctcttccagtagtcttgtttataccatgtggttgtttgtgtgtcacttttccctttctctccttaacataattgtcttgtgttaaggatctcaaaaagatttcatgagacaagctggggaagtaacctttgcggatgcacatcgacctaaactaaatgaaggggtagttgagtttgcctcttatggtgacttaaagaatgctattgagaaactttctggaaaggaaattaatgggagaaaaatcaaattaattgaaggcagcaaaagacacaggtcaagaagcaggtcacgatctcggaccaggagttcctctaggtcccgtagccgatcccgttcacgcaggagcaagtcttacagccgatcaaggagcaggagccggagccggagcaagtcccgttctggtagtaggtctcccgtgcctgagaagagccagaaacgtggttcttcgagtagatctaaatctccagcatctgtggatcgccagaggtcccgatcccggtccaggtccagatcagttgacatggcaattaattaaactgtaaataacttgcctgggggcctttttttaaacaaaacaaaacaaattcccaaaccatacttgctaaaaattctggtaagtatgtgctttttctgtggggtgggatttggatggggttgggctggatttctttgtagatgtggaccaccaaggggttggtgaaaactaattgtattaaatgtcttttgataagccttctgctcacacttttgtgactgtctgaagtatatagttgtgtatatgatagagctcttttataactaaacgatttaattttttgtactgaaaaaatttgaatattttagttcatgttcagatatgttaacataagattagtttaatttgctcaattaaactaatgaatagctttggacactttaaaagagctctaaatttgcttgtatataaaagcttagtttgagttttccttgttagggtcaagggtgtcttcttgcccattaacagctgtagatagacttaaagcagctgtttgttactgataataaaatactaagtattataaaa

SEQ ID NO: 2050 - DNA, 1136 bp, Rattus norvegicus
  Genbank Accession No. NM_019262
gggcttcttggacgtttttgggaggggacagcaagggaaggtccttctgcctctagggacccagacttccgctttctgcagacagcagcaggctctgggctctgggaatccactgctgtctggcctagaagcatcatagaacacgaggattccatacacaggaggcccctgaagctgagctgagctgatgaagacacagtggagtgagatcttgacacccctgttgctgctgctcctgggtttgctccatgtctcctgggcccaaagcagctgtactgggtcccctggcatccctggggtccctggcatccctggggtccctggctctgatggcaaaccaggcactccagggataaaaggagagaaagggctccccggactggctggagaccatggtgagttaggagagaaaggggatgcagggatccctgggatcccaggcaaagttggccccaagggtcccgtcggccctaagggtgctccaggcccccctggaccccgcggtcccaaaggtggctctggagactacaaggctacccagaaagtagccttctctgccctgaggacggtcaacagcgccctgcgaccaaaccaggccattcgcttcgaaaaggtgatcaccaatgttaatgataactacgagccgcgcagtggcaagttcacctgcaaggtacctggcctctactacttcacctaccacgccagttcccgcgggaatctgtgtgtgaacatcgtgcgcggccgcgaccgagaccgcatgcagaaagttctcaccttctgcgactatgcccaaaacaccttccaggtcaccacgggtggggtagtcttgaagctggagcaggaagaggttgttcacctgcaggccacagacaagaactccctgctgggcgtcgagggagccaatagcatcttcactggctttctgcttttccctgacatggatgtatgatcacggggtcaaatcactcctatccaaaacctcctccctgccagtaatcctccctggaccccagacactgccctttgactgcccaaagccctgaccagagccctgtagatgttacagaatgggtaaataaactcttcaaggccaagaaaaaaaaaaaaaaaaaaaaaaaaaaaaaaaaaaaaaaccc

SEQ ID NO: 2051 - DNA, 3115 bp, Rattus norvegicus
  Genbank Accession No. NM_019280
gttgaacagcagccagagcctgaagaagccaactccagggcggaggaaaggaagcagaaggctcagcaccagtctccaacacttggcaagatgggtgactggagcttcctgggggagttcctggaggaggtccacaagcactctacggtcatcggcaaggtctggctcaccgtcctgttcattttccgcatgctggtcctcggcaccgctgctgagtcctcctggggagatgagcaggctgatttccggtgtgataccattcagcctggttgccaaaatgtctgctacgaccaagccttccccatctcccacattcgttactgggtactgcagatcatctttgtgtccacaccatctctggtgtacatgggccacgccatgcacactgtgcgcatgcaggaaaagcagaagctgcgggaggctgagaaagctaaagaggccggtggcaccggcacctatgagtacttggcggagaaagccgagctgtcctgctggaaagaggtgaacgggaagattgtcctccagggcaccctactcaacacctatgtctgcaccattctcatccgcaccgctatggaggtggccttcatggtgggccagtacctcctctatgggatcttcctggacaccctgcatgtctgccgcagaagtccctgtccccaccccgtcaactgttatgtctcgaggcccacagagaagaacgtcttcattgtctttatgatggctgtggctggactgtctctgtttctcagcctggctgaactctaccacctgggctggaagaagatccgacagcgcctggccaagtcacggcagggtgacaagcaccagcttcttggcccctccaccagcctggtccagggcctcactcctcctcctgacttcaaccagtgcctaaagaacagcccagatgagaaattcttcagtgacttcagtaataacatgggctcccggaagaatccagaccctctggccactgaggaagtgccaaaccaggagcagatcccggaggaaggtttcatccacacacagtatggccagaagcccgagcagcccagtggcgcctctgcaggccaccgctttcctcagggctaccacagtgacaagcgccgccttagtaaggccagcagcaaagcaaggtcagatgacctgtcagtgtgaccctcctcttagggaggaccagtcccagaaggaagccaaggagggtgaggcaggacagaagcggtctctctgactgtataccttcctcagcaccttctctcccgggtctggatggtgttgctcattaatcctccaaatttcagttctgagccgtattctcaaagattgggctactcctcaaatccccaaccccacatcctctaccagtattcgcagtgaagactttcaagtgatttagtgatatggtgggagcaggaatgggaaccttggcaaaatctggtctgggtaggacagacatgaagattcgacattagcaacagataaaccctcaccccaaatcttgtcttcttcggtactaggcccatcctttttattttttaaaggaagaatccaaggttgagagtattcatcaaataatctgcattgtattgttcctttgaatctgtcgtttccatgtgccatacctcagagtgctggtgaggtaactgtgggttgcccttggctgcatctccctcctcccagtcttaaaggggtgtccttggtcctcggccagcatcagctttacaagtgccttggtatgtgcctttggaaaacactgcatgttgatgatgctgcagccttactgccaggctagacacccagctcagaagggtgccaagacctctagaagtcactgtgcacataagcattgctggaattgccaccagctgtcatcctgcagtcctttacagttcaacctagtgatagaaaccgtcctggacagctcacccagtgttcctctaaaatcttggttaacaggaatgtccaaagtcaccatcctctcttggaccctggccagattaccagccaccaagttcagtggaatttccccaggatttaatgaaacaaagagagcattgtgcttctcaggttccttggggggtgttgggggggattcttctgtggagatgaaaagagaggagggggaggacactggaaaactattttcccttctgcatatgccttccactgcctcccagcttggactgctgagaggtgtggtgatagatagcaacggaggcccaagatctctctcttagaggcatcaaggggacctggaagccgagatggagctccggttggttttgacacggcccttatttagtgcagatgctcctgtgtttccttgggacccttaggtacatcagggagggactgtagaaaattcctgccttcctcagggtctatcctgggctatctactgagaggatccacagtcggtgtctctccttatgcagatggaaagatgctcagcgtcagatatcaagacttacaaacacaatgctctgtgtgtgtgtgtgtgtgtgcatgtgtgtgtatgagtgtgtgcatactcaaccatctatgtgtgtatatgtgtgtgtgtgcatgctcaaccatctgtgtgtgtgtgtgtgtgtgtgtgtgtgtgtgtgtgtgtgtgtatacccgtgtatgcatgcagatagaatggtaaagaagagccctgaagaactgtaaggaaacatgtagaaaacttgggtttttctgcctccttttctgttgcccgacaggacagctgagcttgcttcctaatcagcctaaaggtcaaacctgggaagtcagtacaggagggtgaaggttcagaggtcaacccctgcccatgtgaccatctctgggtccctctgctggtatttggatggctgaagatacttgggaaaggctgactggctgtcccagccccagtgtatctcattcattcctgacaccgacgctatgattctctgcttttctagttatgggatgtgtgtttgtcttctgaaatggggccttttgagttagaaaatctgagaccagtcttcgatggtgaggtttttcagaagagaaagagaaagtaatatgtgtgactggttttaaataaaatacgtctctacatgttaaaaaaaaaaaaaaaaaa

SEQ ID NO: 2052 - DNA, 1940 bp, Rattus norvegicus
  Genbank Accession No. NM_019283
cacaaccaccaaatatatccacacgttgacgtgatttcttgcccttactcacactaagcccgcgtgtcgatccatctctatggatcccgaacctactgaacactccaccggcggcggctcggttccccgccagccgcccagcgcgcagacggggcttgatgtccaggttgtcagcgcagctggcgactcaggtaccatgagccaggacaccgaagtggacatgaaagatgtggagctgaacgagctggaaccggagaagcagcctatgaatgcagcggacggggcggcagccggggagaagaacggtctggtgaagattaaggtggccgaagacgaggcggaagccggggtcaagttcacaggcttatccaaggaggagctattgaaggtagctggcagcccgggctgggtgcgcacccgctgggcgctgctgctgctcttctggctcggttggctgggtatgctggcgggcgccgtggttatcatcgttcgggcgccacgctgccgtgagctgccggtacagagatggtggcacaagggcgccctctaccgcatcggcgaccttcaggccttcgtaggcccggaagcgagaggcatagctggtctgaagaaccatctggagtacttgagcaccctgaaggtgaagggcctagttttgggcccaattcacaagaaccagaaggatgaagtcaatgaaaccgacttgaaacagattgatcccgatttaggctcccaggaagattttaaagaccttctacaaagtgccaagaaaaagagcattcacatcattttggacctcactcccaactataagggccagaatgcatggttcctccctcctcaggctgacattgtagccaccaaaatgaaggaggctctgagttcttggttgcaggacggtgtggatgggttccaagttcgggatgtgggaaagctggcgaatgcatccttgtacttggctgagtggcagaatatcaccaagaacttcagtgaggacaggcttttgattgcagggaccgcgtcctctgacctgcaacaaattgtcaacatacttgaatccaccagcgatctgctgctgaccagctcatacctgtcacagcccgttttcactggggagcatgcagaactcctagtgattaagtatttgaatgccactggcagccgctggtgcagctggagtgtgtcgcaggcaggactcctgacatcctttataccggctcagtttctccgactctaccagctgctgctcttcactctgccaggaactcctgttttcagctatggggatgagcttggccttcaggcagttgcccttcctggacagcctatggaggctccattcatgctgtggaatgagtctagcaactcccaaacctcaagtcctgtaagcctcaacatgacagtgaagggccaaaatgaagaccccggctccctcctcacccagttccggcgactgagtgacctccgtggtaaggagcgctctctgttacacggtgactttgatgcactgtcttcctcatctggcctcttctcctacgtccgccactgggaccagaatgagcgttacctggtggtgctcaacttccaggatgtgggcctgtcagccagggtaggagcctccaacctccctgctggcataagcctgccagccagtgctaaccttttgcttagtactgacagcacccggctaagccgtgaggagggcacctccctgagcctggaaaacctgagcctgaatccttatgagggcttgttgttacagttcccttttgtggcctgatccctctacacagaacctgccacccttctttcctctctcaggcctttggaattctggtctttctctccttattttgtttttgtttttaaacttttgcagattacatatgaattcttacactgggtgtttttgtcttcaaaataaaaaaaatcacccctgc

SEQ ID NO: 2053 - DNA, 3357 bp, Rattus norvegicus
  Genbank Accession No. NM_019285
cggggcagccagcctacccaggttccctcctggagcctagctttgctacgagaacttcaggagcttaacacaaagcaggcaggggctccgggctggggcgggggatatcatggcccgcctcttcagtccccggcctcctcccagcgaagatctcttctacgagacttactacagcctgagccaacagtatccactgctaattctgcttctggtcattgtgctctgcgcgatcgtggcactgcccgccgtcgcctgggccagcggcagggagctgacctcagacccaagcttcctgacaactgtgctgtgtgctttgggtggcttctccctgcttttggggctcgcttcccgggagcagcaactgcagcgatggacacgacctctttctggcctcatatgggctgctttgctggctctgggctatgggtttctattcactgggggtgtggtgagcgcctgggatcaggtgtcctttttcctcttcatcattttcaccgtgtacgccatgctgcccttgggcatgcgggatgctgctgccgcgggggtcatctcatccctctcacacctgctggtccttggactgtaccttgggtggcggcctgagtcgcagagggatctgctaccacagttggcagcgaatgcggtgttgttcctgtgtgggaacgtggtgggagcataccacaaggcactgatggagcgagcattgcgcgccacgttccgggaggctcttagctccctgcattcacgccggaggttggacactgagaaaaagcaccaggagcacctcctcttgtctatccttcctgcctacctggcccgagagatgaaggcagagatcatggctcggctgcaggctggacagagctcacggccagagaacacaaacaactttcacagcctgtatgtcaagaggcaccaaggagtgagtgtgctgtatgctgacatcgtgggcttcacacggctggccagtgagtgttcccctaaggagctggtgctaatgctcaatgaactcttcggcaaattcgaccaaattgcaaaggagcacgaatgcatgcggatcaagatcctgggagactgttactactgtgtatccgggctgcccctctctctgcctgaccacgccatcaattgcgtgcgcatgggactggacatgtgccgggccatcaggaaacttcgggtagccaccggtgtggatatcaacatgcgtgtcggtgtgcactcaggcagcgtcctctgtggagtcatcgggctacagaagtggcagtatgatgtctggtcccatgatgtcacattggccaaccatatggaagcaggcggcgttccaggacgagtgcacatcacaggggccacgctggccctgctggcaggagcttatgctgtggagagagcagacatggagcatcgagacccataccttcgggagctaggggaacccacatacctggtcattgatccttgggctgaggaggaagacgagaagggcaccgagagaggattgctgtcttctctagaggggcacacgatgcgtccgtcactactgatgactcgttatctggagtcttggggtgcagccaagcctttcgcccacctaagccacgtcgacagtcctgcatccacatccactccactcccggagaaagccttcagcccccagtggagcctggaccggagtcgcaccccccgcgggctacacgatgaactggacactggagatgccaagttcttccaggtcatcgaacaactcaactctcaaaaacagtggaaacagtcgaaggacttcaacctcctgacgctctacttcagagagaaggagatggagaaacagtatcggctgtctgcgctccccgccttcaaatactacgcagcctgcaccttcctggtttttctgtccaacttcacaatccaaatgctggtgacaaccaggcccccagctctggccaccacctacagcatcaccttccttctcttccttctcctcctcttcgtctgcttctcagagcacctgacgaagtgcgtccagaaaggccccaagatgttgcactggctgcctgcgctgtctgtcctggtggccacacggccgggattgcgagtagccctgggcacagccaccatcctcctggtgttcactatggccgtcgtcagcctgctcttcttaccagtgtcgtcagactgccctttcctggctcccaatgtgtcgtcagtggcttttaatacttcctgggagctgccagcatccctgcctctcatcagcatcccatactccatgcattgttgcgtgctgggtttcctttcctgctccctttttctgcacatgagcttcgaactgaagctgcttctgcttctgctgtggctggtggcatcttgttccctatttctgcactcccacgcctggctgtccgactgcctcattgcccgcctttatcaaggctcattgggctccaggccgggggtactgaaggaaccgaaactgatgggagctatctacttcttcatcttcttcttcacactcctcgtcctggctcggcagaatgagtattactgtcgcctggacttcctatggaaaaagaaactgaggcaggagcgagaggaaactgagacaatggagaatgtactccctgcacacgtggcgccccagctcatcggccagaaccggcgcaatgaggacctctaccatcagtcgtacgaatgtgtttgtgtcctctttgcatccatcccagactttaaggaattctactcggaatccaacatcaaccatgaggggctagagtgtctgcggctgctcaatgagatcattgccgactttgatgagctgctctccaagccaaagttcagtggagtagagaagatcaaaactatcggcagcacctacatggcggccacaggcctaaatgccacccctgggcaggacacacaacaggacgctgagagaagctgcagccatctgggcaccatggtggaatttgcagtggccctggggtctaagctgggtgtcatcaataagcactcgttcaacaacttccgcctgcgtgtggggttaaaccatggaccagtcgtagcaggggtgattggggcacagaagccacaatatgacatctgggggaatacagtgaacgtggccagccgcatggagagcacaggagttctcggcaagatccaagtgaccgaggagacagctagggccctgcaatccctgggttacacatgctacagccgaggtgtcatcaaggtcaagggcaaagggcaactctgtacctacttcctgaacacagacctgacacgaaccggatctccctcagcatcctagacacctgagctccccttctccaagatcctcaataaaatgtctccaggcatctg

SEQ ID NO: 2054 - DNA, 1430 bp, Rattus norvegicus
  Genbank Accession No. NM_019289
atggcttaccacagcttcctggtggaacccatcagctgccatgcctggaacaaggaccgtactcagatcgccatctgccccaacaaccacgaggtgcacatctacgagaagagcggtgccaagtggaacaaggtgcacgagctcaaggagcacaacgggcaggtgacaggcatcgactgggcccccgagagtaaccgcattgtgacctgcggcacagaccgcaatgcctatgtgtggacgctgaagggccgcacgtggaagcccacgctggtcatccttcggattaatcgagctgcccgctgcgtgcgctgggcccccaatgagaacaagttcgccgtgggcagtggctcccgtgtcatttccatctgttattttgagcaggagaatgactggtgggtgtgcaaacacatcaaaaagcccatccgctccactgtccttagcctggactggcaccccaacaacgtgctcctggctgcaggctcctgtgacttcaagtgcaggatcttctctgcctatatcaaggaggtggaggaacggccagcccctacaccgtggggctccaagatgccctttggggagctgatgtttgaatcgagcagcagctgtggctgggtgcatggtgtctgcttctcggccggtgggagccgagttgcttgggtcagccatgacagcactgtgtgcctggtagatgctgagaagaagatggccgtggcaaccctggcctctgagacattaccgctcctggccatcaccttcatcacagaaaatagtctcgtggcagcgggccacgactgcttcccggtgctgtttacctatgacaacgctgcggggacattgagctttggtggccggctggatgtgcccaagcagaactcccagcgtggcctgacagcccgagagcgcttccagaacctcgacaagaaggccagctctgaagggggtgcagccacaggggctggcctggattcactgcacaagaacagcgtcagtcaaatctcggtgctcagcgggggcaaggccaagtgctcgcagttctgcaccacaggcatggacggtggcatgagcatctgggatgtgaagagcttggagtcagccttgaaggacctgaagatcagatgagctgtgaggagtgctgtcctcatcccacatgctggggaggagggaaaggggttggggaggctaagggctgctttgctgaatgcttctagggtgtagtacaggtctgcaaaggggatgctctctctccaaagaggggaagaggaaggtggggaactttcctgcctatttaatgaaaatgtgccttttaaagagatgctttcattcattgcaaaccaaaaacaagacaaaaaacccaaagcacaatgctggtcataaactgcttcaaaatgtgggctaataaacataccaaatgtgaaaaaaaaaaaaaaaaa

SEQ ID NO: 2055 - DNA, 1259 bp, Rattus norvegicus
  Genbank Accession No. NM_019290
ggcacgagggcgagggtgcagccccggagcggcggcggggcaaaatgaaaaacgaaattgctgctgttgtcttctttttcacaaggctggttcgaaagcatgataagttgaaaaaagaagcagttgagaggtttgctgagaaattgactcaaatacttcaagagaaatacaaaaatcactggtatccagaaaaaccctcaaaaggacaagcctacagatgcattcgtgtcaataagtttcagagagttgatcccgacgtcctgaaagcctgtgaggacagctgcatcctgtacagtgacctgggcttgccaaaggagcttacactctgggtggatccgtgtgaggtgtgctgccggtatggaaagaaaaacaatgcattcattgttgccagctttgaaaatgaggatgagaacaaggatgagatctccaagaaagttagcagggctcttgataaggtgacctctgattatcattcagggtcctcctcctcagatgaagacacaagcaaggaagtagaagtgaaaccgagtgcagtggctacaacgccaagccccgtgtaccagatttcagaactgatattcccacctcttccaatgtggcaccctttgcccagaaaaaagccaggaatgtaccgagggggtggccatcagagtcactaccctcctcctgttccatttgcttatccaagtccaggaaggaagaataaagcgttccgcccaattccagtgacatgggtacctcctcctggaatgcattgtgatcggaatcactggattaatcctcacatgttagcacctcactagttcatttggattgggcggatgtcattttgatagaaaggaagaaataccttcttagatacttaagagtttcacaacttgtagtgaagtcagatggacaaaaccatcaggcttatttttatagaaaagctattgagataatctttcttaaagtatatatatatatgcactttagatatattgatatagtttgagaaactttattaaagttagtcaagtgcctgagtttttaatattggacttgagtatttatatattgtgcattgactctgttggatacaaaacactgtaggagggcgatatgttttagcacctttgagcatttactttatggagaatatgtaagttatttatacagaaggacatttattttatgtcacatagaagaattgtgtgaaatcatgtagttgcaaataaaaagtagtttgaggcgtgaaaaaaaaaaaaaaaaaaaaaaaa

SEQ ID NO: 2056 - DNA, 1459 bp, Rattus norvegicus
  Genbank Accession No. NM_019291
gcgtgactatgtcccaccactggggatacagcaagagcaacggaccagagaactggcacaaggagttccccattgccaatggagaccgacagtcccctgtggacattgacaccgggactgcccagcatgacccttccctacagcctctgctcatatgttacgataaggttgcttccaagagcattgtcaacaatggccattccttcaacgttgagtttgatgactcccaggactttgcagtgctgaaagagggacccctcagtggctcctacagattgatccagtttcactttcactggggctcatctgatggccagggctctgagcacaccgtgaacaaaaaaaaatatgctgcagagcttcacttggttcactggaacaccaaatatggggattttggaaaagctgtgcagcacccagatggactggctgttttgggtatttttttgaagattggacctgcctcacaaggccttcagaaaatcactgaagcactgcattccattaaaacaaaggggaaacgtgcagcctttgctaactttgatccttgctcccttcttcctggaaacttggactactggacatatcctggctctctgaccactccgcccctgctggaatgtgtgacctggatagtgctcaaggaacccattactgtcagcagtgagcagatgtctcatttccgtaaactgaacttcaattcggagggggaggctgaagaactgatggtggacaactggcgtccagctcagccgctgaagaacagaaagatcaaggcgtcctttaaataaaatgaccctgcagctggggtccaaaaagcacaagtgtggctgcctctctgtagctaagcacagttccgccttggtgattcagatcccgactttgcatctgatattgtaggcctttttacctctcacccattgtgcttactaataaaatgtgaaaaggaagacccaggtgtctcatgtggtggtagcatggtggcaggctggtggttgacttagggcatcctttctcagccacaacaatgcaatgcaaagaacagatatggcctcttgcttctccacagccatagaataatgagtactcaggcctgtttattaaaatgctatttttaaaaccatataaggtagaatgattgtttacaaatccacatcatgagacaaactgaggcaatttaggcaaatcaggtaaaacagtcatagttttatggttattaattagatgaatgttcactattccaagatcttatattaaagaaaaacttttaaaaagcttatatatttgtagcaaagttattcttaaatatgaattatgttgtaacttagtgacttttgatttctagaggtgtaaatgaagatgtaaaaattgatatagttgtgatacagagtatatttcccttcagataacttaccataacctaatggataatgtattttagatatattctctaataaaa

SEQ ID NO: 2057 - DNA, 6071 bp, Rattus norvegicus
  Genbank Accession No. NM_019299
ccctcccttccccttctcctcctctcccttggagagcccgggcaggcactgccctgcagccccagtgacaggaggagaccatactccccgacagcgccatggcccagattctgccaattcgctttcaggagcatctccagctccagaacctgggtatcaacccagcaaacattggcttcagtaccctgactatggagtcagacaaattcatctgcattagagaaaaagtgggagagcaggctcaggtggtgatcattgacatgaatgatccaagtaatccgattcgaagaccaatctcagcagacagtgccatcatgaatcctgccagcaaagtgattgcactgaaagctggaaaaactctacagatatttaacattgaaatgaaaagtaaaatgaaggcccacaccatgaccgatgatgtcaccttctggaaatggatctctctgaatacggttgctcttgttacggataatgcagtttatcactggagcatggagggggagtctcagccagtgaagatgtttgatcgtcattccagcctcgcagggtgccagatcatcaattaccgtacagatgctaagcagaagtggttgctcctgactggcatatctgcacagcaaaatcgcgtggttggagctatgcagctgtattctgtagacaggaaagtctctcagcccattgaagggcatgcggcgagttttgcacaatttaagatggaaggaaacgcagaagaatcgacgttattttgttttgctgtgcggggtcaggcaggggggaagttacatatcattgaagttggtacaccacccacaggaaaccaaccctttccaaagaaggcagtggatgtcttctttcctccagaagcacaaaatgattttcctgttgcaatgcagatcagtgaaaagcatgacgtggtgttcctgattaccaagtatggttatattcacctctatgaccttgagactggcacgtgcatctacatgaacagaatcagtggagaaaccatctttgttactgctcctcatgaagccacagctggaataataggagtcaacagaaagggacaagtcctatcagtttgtgtggaagaagagaacataattccttacatcaccaatgtcctacaaaatcctgatttggctctgagaatggctgtgcggaacaacctagctggtgcagaagagctcttcgcccggaaatttaatgctctcttcgcccagggaaactactcagaggctgcaaaggtggctgctaatgcaccgaagggaatccttcgtactccagataccatccgtcgattccagagtgtcccagctcagccaggtcaaacttcacctctgcttcagtattttggaatccttttggaccaaggccagctgaacaaatacgagtccttagagttatgtagacctgtccttcagcaagggcggaaacaacttttggagaaatggctgaaagaagataagctggaatgttctgaagaactgggtgatctcgtaaaatctgtggacccaacgttagcactgagtgtatacctcagggccaatgtccctaataaagtcatccagtgctttgcagagacaggtcaagtccagaagattgttttatatgctaaaaaagttggctatactccagactggatctttctcctgagaaatgtcatgcggatcagtccagatcaaggacagcagtttgcccaaatgttagttcaggacgaagaacctcttgctgatatcacacagattgtggatgtctttatggaatacaatctaatccaacaatgtactgccttcttacttgatgctttgaagaataatcgcccttctgaaggtcctttgcagacgcgattgcttgagatgaaccttatgcacgcacctcaagttgcagatgccattctagggaatcagatgttcacccactatgaccgggctcacatcgcccagctgtgtgagaaggcgggcctactgcagcgtgcattagaacatttcaccgacttatatgatataaaacgagcagtcgttcatacccatcttctcaaccccgagtggttagtgaattactttgggtccttatcagttgaagattccctagaatgtctcagagccatgctgtctgctaatattcgtcaaaatctacagatctgggttcaggtcgcttctaaatatcatgaacagctgtcaactcagtccctgattgaactcttcgagtcattcaagagttttgaaggcctcttttattttctggggtccattgttaacttcagtcaagacccagatgtgcactttaaatatattcaggcggcttgcaagactggacaaatcaaagaggtggaaagaatctgcagagagagcaactgctatgatccagagcgcgtcaagaatttcctcaaggaggcgaaactcacagatcagttgccactcatcatcgtctgtgaccgctttgacttcgtccatgacctggtgctgtatttatacagaaacagtcttcagaagtacatagagatatatgtccagaaagtaaatccaagtcgacttcctgtggttattggaggattgctggatgttgactgctctgaagatgtcattaaaaatttgattcttgttgtgagaggtcaattctctactgatgagcttgttgctgaagttgagaaaagaaacagattgaagctgcttcttccttggcttgaggctagaattcatgagggctgtgaggagcctgctacacacaatgcgttagccaaaatatacatcgacagcaataacaacccagagagattccttcgtgaaaacccctactatgacagtcgtgtcgtgggaaagtactgtgagaagagagacccacatctggcctgtgttgcttatgaacgtggccagtgtgatctggaactaatcaacgtttgcaatgagaattccctcttcaaaagtctttctcgctacctggtccgtcgaaaggatccagagttgtggggtagtgtgctactggaaagcaatccatacagaagaccattaattgaccaggtcgtacagacagccttgtctgaaactcaggacccagaagaagtgtcagtaactgtcaaggcttttatgacagcagatcttcctaatgaactcattgagctgctggagaaaattgtccttgataactctgtattcagtgaacacaggaatctgcaaaacctcctcatcctcactgcaattaaggctgaccgaacccgagttatggagtatattaaccgcctggacaattatgatgcgccagatattgccaacattgccatcagcaatgagctcttcgaagaagcatttgctattttccggaagtttgatgtcaatacttcagcagtgcaggtgttaattgaacatattggaaacctggatcgtgcatatgagtttgctgaacgctgcaatgagcctgctgtttggagtcaactcgcaaaagctcagttgcagaaagggatggtgaaggaagccattgattcttacatcaaagcagatgatccttcgtcttacatggaagttgttcaggccgccaatactagtggaaactgggaagaattggtgaagtatttgcagatggcacgcaagaaggcccgagagtcctacgtggagacagaattgatatttgcactggctaaaacaaaccgtcttgcagaattagaagagttcatcaatgggccaaataatgctcatattcagcaagttggtgaccgttgttatgatgagaaaatgtatgatgctgctaagttgttgtacaataatgtttctaactttggacgtttggcgtctaccctagttcaccttggcgagtatcaggcagcagttgatggtgctagaaaagctaatagtactcgaacatggaaagaggtctgctttgcctgtgtagatgggaaagagtttcgccttgctcagatgtgtggactccatattgttgtgcatgcagatgaattagaggagcttatcaactactatcaggatcgtggatattttgaagaactcatcaccatgttggaggcagccttgggactagagcgagctcacatgggaatgttcacagagctagcaattttgtattctaaattcaagccacagaaaatgagggaacacctagagttgttttggtcaagagtgaatattcctaaggtgctgagagccgcagagcaagcccatctttgggcagagctggtgtttctgtatgacaagtatgaagagtatgataatgccatcatcactatgatgaatcaccccaccgacgcatggaaggaagggcagttcaaagacatcatcaccaaggtggctaatgtggaactgtactacaaagcaatccagttctacttagaattcaagcccttgttgttaaatgacttgctcatggtgctgtctccacggttggctcatactcgtgcagtcaattatttcagcaaggttaaacagctaccactggtgaaaccatatttacgctcagttcagaaccacaacaacaagtccgtgaacgaatccctgaacaacctctttatcacagaggaggattaccaggctctgcgaacatcaatagatgcttatgacaactttgacaacatctcacttgctcaacgtttggaaaaacatgaactcattgaattcagaagaattgctgcttatctcttcaaaggaaacaatcgctggaaacagagtgtggagctgtgcaagaaagacagcctttacaaggatgcaatgcagtatgcctctgaatcgaaagacacagaattggctgaagaactcctgcagtggtttctgcaggaagagaagagagaatgctttggagcttgtctcttcacctgctacgatcttttaaggccagatgttgtcctggaaactgcatggagacataatatcatggattttgccatgccctatttcatccaggtcatgaaggagtatttgaccaaggtggataaattagatgcttcggagtcactgagaaaagaagaagaacaagctacagagacacagcccattgtttatggtcagccccagctgatgctaacagccggacccagtgtggcagtccctccccaggcaccttttggttatggttatactgcaccaccatatgggcagccacagcctggctttgggtacagcatgtgagacggaagctgatcccgtagtctcctattttcatactgaagcatcgtccacccacttctcagtttataaacgggaaacaggcaacgtgttcttgtaacctttacttcatgaaggactacctttttgttctaactatagactcggatcgcctaggttaaaactttattttcacattccgcatcattagaccttcttttcaaaggggaatagtactcacgtgggctttttctccccctcattctttgaagaactgattactattcaatctattgtgaagaacctgatttgcactctgtagtgtttaaagaaacaaagaaactctaatattgaatctcttaaatttagtgtatgtaaacagctttcactatgtattctgtaaatgcaccccattctcttttattcaaagaaaagctaacgtgaaaatactgctatgtgaccatgcaagactgtcagagccaacaaagacaacactaatcagcatatcttacattggaatcacagcgctctccaaattatttgaaaatgcatacagacaacttgcctgattttttttttttttaaaacgagtatcacaggccctgtaacctatgcaggtttccccattatgcatatagaaaatgctagtgtgttgctcacttcatgtgtaacaggtgccctcatgttgtgctgtatcctgtgctttttctgtgggaccattccattcaggaacaaagagcaccatgactgcacacgtgtgtatttactaacccttccctgaggtgtgtgtatgttggatattgtggtgttttagatcactgagtgtacagaagagagaattcaaacaagatattgctgttcttcagttttgttcgtggaatttgaaattactccaatttaaaataaattactggactgtggaaataacatgtagaattgcagttttaattaaatacatctcaaaaccag

SEQ ID NO: 2058 - DNA, 2002 bp, Rattus norvegicus
  Genbank Accession No. NM_019328
ccctttaatttcctcgaaaactccaatcactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaattactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgccccctcagtccgaggagatgatgccacacagcgggtcggtttactacaagccctcttcgcccccgacacccagcaccccgggcttccaggtgcagcatagcccgatgtgggacgatccgggctcccttcacaacttccaccagaactacgtggccactacgcatatgatcgagcagaggaagacacctgtctcccgcctttcactcttctcctttaagcagtcccgcccgggcactcctgtgtctagctgccagatgcgctttgacgggcctctgcacgtccccatgaacccggagcccgcgggcagccaccacgtagtggatgggcagaccttcgccgtgcccaatcccattcgcaagccggcatccatgggcttcccgggcctgcagatcggccacgcgtcgcagttgcttgacacgcaggtgccctcgccggcgtcccggggctctccctccaatgagggtctgtgcgctgtttgcggtgacaacgcggcctgtcagcattacggtgttcgcacttgtgagggctgcaaaggtttctttaagcgcacggtgcaaaaaaacgcgaaatatgtgtgtttagcaaataaaaattgcccagtggacaagcgccgccgaaatcgttgtcagtactgtcggtttcagaagtgcctggctgttgggatggttaaagaagtggttcgcacggacagtttaaaaggccggagaggtcgtctaccctcaaaaccgaagagcccacaggatccctctcccccctcacctccggtgagtctgatcagtgccctcgtcagagcccacgtcgactccaatccggcaatgaccagcctggactattccaggttccaggcaaaccctgactatcagatgagtggagatgatactcaacatatccagcagttctacgatctcctgactggctctatggagatcatcagagggtgggcagagaagattcctggctttgctgacctgcccaaagccgatcaggacctgctttttgaatcagctttcttagaattatttgttctacgcttagcatacaggtccaacccagtggagggtaaactcatcttttgcaatggggtggtcttgcacaggttgcaatgcgtgcgtggctttggggaatggattgattccattgttgaattctcctccaacttgcagaatatgaacatcgacatttctgccttctcctgcattgctgccctggctatggtcacagagagacacgggctcaaggaacccaagagagtggaagagctacaaaacaaaattgtaaattgtcttaaagaccatgtgactttcaataatgggggattgaaccgacccaactacctgtccaaactgttggggaagctcccagaacttcgcaccctttgcacacaggggctccagcgcattttctacctgaaattggaagacttggtaccaccaccagcaataattgacaaacttttcctggacaccttacctttctaagactttctcccatgcacgtcaaagaactggaaagaaaaaaaaaatccagagggggctggtcaagatgggtagagagctggctgaagtgtccggttcatgtctcccttctgtagacccctagccctcacccctaaagtaaacaaacaaacaagcaaacaaacgg

SEQ ID NO: 2059 - DNA, 4259 bp, Rattus norvegicus
  Genbank Accession No. NM_019331
aaaaaagaggattccgtggcttaaaaaaaaagtttgaaagcctctgacttaatagtttccaccaccaaggaaactgaggcccagagagaggaaatgacctgggtaagatctccgagggaccagtagttgaacagggactaggagttaaaatttcatgggaggtgcctgtaacaggacctgccttggggtctctgctggaaagagagacctgattgggtttcccagcagtcttcagtggcttgctccgtggctgcctcagccaggtctccagcagccacacctggggatctggcccccgtcctgtcctccagccccacccacctcggctccatgccccccccagtcagcttcgggaccctggcagtgagcaggcacgtggcagccaaggccctgtgaccaggccagggagacggagctctggggtcccagtcacctgcccccccatggagctgagaccctggttgctatgggtggtagcagcagcaggagccttggtcctgctagcagctgaagctcgcggccagaagatcttcaccaacacgtgggctgtgcacatttctggaggcccagctgtggctgatagtgtggcacggaagcatgggttccacaacctgggccagatcttcggtgactattaccacttctggcacagagcagtgacaaagcggtccctgtcgcctcaccgcccgcggcacagccggctacagagggtgcctcaagtgaagtggctggagcagcaggtagccaagcaaagggccaagagggacgtgtatcaggagcccacagaccccaagttccctcagcagtggtacctgtctggggtcactcagcgagacctgaatgtgaaggaagcctgggcccagggcttcacagggcgtggcattgtggtctccatcctggatgacggcattgaaaagaaccatcctgacttggcaggcaattatgacccgggagccagctttgatgtcaatgaccaggaccctgacccacagcctcggtacacgcagatgaatgacaacaggcacggcactcggtgtgccggggaagtggcagcggtggccaacaatggtgtctgtggtgtaggtgtagcttacaatgcccggattggaggggtgcgtatgttggatggcgaggtgactgacgcggtagaggcacgttcgctgggcctgaatcccaaccacatccacatctacagcgccagctggggccccgaggacgacggcaagaccgtggatgggccagcccggctcgccgaggaggccttctttcggggagttagccagggccgcggagggctgggctccatctttgtctgggcctcagggaatgggggccgggaacatgacagctgtaactgtgacggctacaccaacagtatctacacgctgtccatcagcagtgccacacaattcggcaacgtgccctggtacagtgaggcctgctcctccacactggccaccacctacagcagtggcaaccagaatgagaagcagattgtgacaactgacttgaggcagaagtgcactgagtctcacacaggcacctcagcctccgcccctttggcagctggtatcattgctctcaccctggaggccaacaagaacctcacctggcgggacatgcagcacctggtggtgcagacctcaaagccagcacatctcaacgctaacgattgggccaccaatggcgtgggccggaaagtgagccattcctatggctacgggctgttggatgcaggtgccatggtggccctggcccagaactggacaacagtggccccccagcggaagtgcatcattgaaatcctggcagagcccaaggacattggcaaacggctagaggtgcgcaagaccgtgacagcgtgcctgggtgagcccaaccacatctccagactggaacacgttcaggcacggctcaccctgtcttacaatcgccgtggtgacctggctatccacctcatcagccccatgggcacccgttccaccctattagctgccagaccacatgactactctgctgatggatttaatgactgggctttcatgacaactcattcctgggatgaggacccctctggcgagtgggtcctagagattgaaaataccagcgaggccaacaactatgggacgctgaccaagttcactctcgtcctatatggcacagcctctgagggtctctctgcacctccagagagcagcggctgcaagaccctcacatccagccaggcctgcgtggtgtgtgaggaaggtttctcactgcaccagaaaagctgtgtccagcgttgcccaccaggcttcacaccccaagtccttgatacacactacagcactgagaatgatgtggagatcatccgtgccagcgtctgcaccccctgccacgcctcatgtgccacttgccagggcccagctcccacagactgcctcagctgccccagccatgcctccctggaccctgtggagcaaacctgctcccggcaaagccagagcagccgagagtcccgacctcagcagccacctcccgcactgcgcccagaggtggaagtggagccccggttgcgggctgggctggcctctcacctgccggaggtcctggccggcctcagctgccttatcatcgctctcatctttggcatcgtcttcctcttcctgcatcggtgttcaggcttcagcttccggggagtgaaagtgtacaccatggaccgtggcctcatctcctacaaggggctgcctcctgaggcctggcaggaggagtgcccatctgactcagaagaggatgagggccggggcgagaggaccgcctttatcaaagaccagagcgccctttgatgagcccactgcccaccctatcaaatcgatcccttcctcggcactttttaattcaccaaagtatttttttatcttgggactgggtttggaccctagctgggaggtgagaggggcagagacccttgggcctacctgtttgcctgaggtggggtcccgggagcctcaccccccaccaaccctccatgtggaggaaggagtaaatctttagggcagcttcctgcagagtgaagaggggcagcctttctgactccctggccagctgcagccttgcccctcccctgcccctcagaaagcaataatggtccccatccaggcaacagggaggctggccaggaggtacttgaagaaggtggccacctctccaagggcttttgcatcccctgaccctctctggctcaggatgagcctctgaagaagcttgcagtcacaggaagggaccaaagcaaacgaggcactctccagtgtgcctgcactcttgctctcagcctgcctctgcactccaggtctccacctcagctggtagccaggctgagctagacctgcacaggtcaggctctggggccttatgctggtgtcctgaccatcctctatggcaccccccccccaagccagggccttgttttctgagcccggggctgcctgggcagttggcgctcacagtccaggagcccctgggtgggtggtggggagggacggtggctcctcccacctcccacccgatgctgctttcccctgtggggatctcaggagctgtttgaggatatattttcactttgtgattattcactttagatgctgatttttttttttttgtatttttaatgggggtagcagctggaccattcaccttctcctacccatgtccaccctgcctttcccatggctgcccagctctgaggcagagggaatcactaagccccaagtcctgaagaggcaggccagccagctgggctccaggaaagggggtcatggtgggaggggtaggctgacatcatctgtttcaaatggggttgtgccacaggcttttgggttgctggctctccaagtgccaggggtgggcaggtggcaccaccaagcccaaactaacactgtgccctggtggagaaagcattggcctatgatgccccccaaaccccctgttctgatgtgcctttcgcacccctcccattaggacaatcagtcccctcccacttgggcctcctcttttctttttcctagcccttctcggtacccaacctacctgtccagggtgccccttgctctcctgcccacccctagcggccatccaggctggttttgtaagatgctgggttggtgcacagtcatttttttttccttgtaatttaaacaggcctggcattgttggttctatttaatggacacgagataatgttagaggttttaaagtgattaaacgtgcagactatgcaaacc

SEQ ID NO: 2060 - DNA, 1739 bp, Rattus norvegicus
  Genbank Accession No. NM_019333
caaataagagaaatctggttgagtgagcctggggatggcgtccccacgggaactgacccagaatcccctgaagaagatctggatgccatacagcaatgggaggcccgccctgcacgccagccaacgtggtgtctgcatgaccaactgcccgacactcatcgtcatggtgggcctgccagccaggggcaagacctacatttctaagaagctgacccggtacctcaactggattggcgtgcctactcgggaattcaacgtgggtcagtatcgccgggacatggtcaagacatacaaatcttttgagttcttcctcccagacaatgaagagggcctgaaaatcaggaagcagtgtgccttggcagccctcaatgacgtccggaagttcctcagtgaggaggggggacacgtggcggtttttgatgctaccaataccacccgagaacggagagcgatgatctttaactttggagaacagaatggctataagaccttctttgttgaatctatctgtgtggatcctgaggtcattgctgccaacatcgtgcaagtgaagctgggcagccctgactatgtgaaccgggacagcgacgaagccactgaggacttcatgaggcgcattgaatgctatgaaaactcctatgagtctctggatgaagaacaggacagggatctgtcctacatcaagatcatggacgtggggcagagttatgtggtgaaccgtgttgccgaccacatccagagtcgcatcgtttattacctcatgaacatccatgtgacaccccgctccatctacctctgccggcacggggagagtgagctcaacctcaagggccggattggtggggaccctggactctccccccggggccgggagttttccaagcacctagctcagttcatcagtgaccagaacatcaaggacctgaaggtctggacgagccagatgaagaggacgatccagacagccgaggcgctgagtgtcccttatgagcagtggaaggtcctcaacgagattgacgcgggtgtctgtgaggaaatgacctacgaagaaatccaggaccactacccgctggagtttgctctgagggaccaggacaagtaccggtaccgctacccgaagggcgagtcctatgaagacctggtgcagcggctggagcctgtcatcatggagctggagaggcaggagaacgtgctagtcatttgccaccaggctgtgatgcgttgcctcctggcctacttccttgacaaggcagcagaagagctgccctacctcaaatgccccttgcacacagtcctgaagctcacacctgtggcttacggttgtaaagtggagtccatattcctgaatgtggcagctgtgaacacacaccgagacagacctcagaatgtagacatatccaggccttcagaggaagcccttgtcacagttcctgctcaccaatgacccatggcaggccctgacctctgcggaggggtcactccaggccacttcttcctgtttgctgtatgaacggtcaccatgcaggaacactcatgggtggctggtaacactcagaaccctcagcctaacccacctgcctccttggtgacaaccagtgacggggttgagtgtggctgctgacctgctgctgagaatctctgggctacgtgctctgctgctggcccctttgctacagctctcaagcagtccgccccccgggctggctgctttgtgacatttgcaacattaaatgagacac

SEQ ID NO: 2061 - DNA, 3808 bp, Rattus norvegicus
  Genbank Accession No. NM_019335
gaactagcctgacctggacttgcccggcagaagcgacagtggtcggagggcgacgagattttaggggcagcacctgaagcacaattcgagtcctgcgccagggcacgggccattgtccggatccagaaagtcggtcaccggggaagaaaaatggccagtgatacaccaggtttctacgtggacaaacttaacaaatactcccagatacacaaagtaaagattatatataaagaaatttctgttacaggacctccacacgacagaaggtttacatttcaagttataatagaagagagggaatttccagaaggtgaaggtagatcaaagcaggaggcgaaaaataatgctgccaaattagctgtcgaaatacttgataatgaaaacaaggtggatagtcacacggatgcttctgaacaaggtttaatagaggggaactacattggccttgtcaattcttttgcccagaaggaaaatctgcctgtaaattttgaactgtgtgaccccgactcccaattgcctcacagatttatttgtaaatgcaaaatcgggcagactacgtatggtactggtttcggtgctaacaaaaaggaggcaaagcagttggctgccaaaaatgcgtatcagaagctgtcagagaaaagcccatcgaaaactggctttgtcacatctttatccagtgacttttccagcagctcgtctataacaagtaactctgcttctcagtcagcatctggaagggatttcgaggacatatttatgaatggtctcagagaaaaaaggaaatcaggagtaaaagtgccatctgatgacgtgctaagaaataaatataccttggacgacaggtttagcaaagattttgaagacatagaagaaattggctcgggtggatttggccaagttttcaaagcaaaacacagaatcgatggaaagacgtatgctattaagcgcattacatataacaccaagaaggcaaagcgtgaagtacaagcactagcagaactcaatcacgccaacattgttcaataccgagtttgttgggagggagaggactatgactatgatcccgagaacagcacaaacggtgacacaagtcgatacaagacccggtgcctctttatccaaatggaattctgtgataaaggaactctgcagcagtggttggaaaagagaaatcggagtcaagaggacaaggctttggttttggagttatttgaacaaatagtgacaggagtggattatatacactcgaaaggtttaattcatagagaccttaagccaggtaatatatttttagtggatgaaaaacacattaagatcggagactttggccttgcaacagccctggaaaatgatggaaatcctcgaacaaagtatacaggaactcctcaatacatgagtccagaacaaaagtcatcgttagtggaatatggaaaggaagtggacatctttgctttgggccttattctagctgaacttcttcacatatgcaaaactgattcagagaaaatagagtttttccaacttctaagaaatggcatcttctccgatgatattttcgacaacaaggaaaaaagccttctacagaaattactctcaagtaaacccagggaacgacccaatacgtctgaaatcctgaagactttggctgagtggaagaacatctcggagaaaaagaaaagaaacacgtgttagggcttttaactgcagtctgaagtggaatgtcagagaacaatgaacttcttctcttaacactctcccagacaggttttggtaagggtgacccaaagacattgtatttatcggctatgaacaagtatgcccgtttcctcaattgttaattgtcggacctgtggctggctagccaaatatggaaatgtttgtttctttctcgtctgcccgaagagaaagccaagccgcggtggagaaggtcacttaacccccaatgctaactgaaggcctaaggcttttgacatactaaagagctggcagccagagctgggagagaagaacctgcagacaggcaggcagagacacaaagacatggactagaatgaaacaggaaggtagagagattgagagacagagccacatggagagacgaaatggcagagtagtaggcttaagttagatgagctaactgagagactgccccagaaaacaggccaacagccttatacacagatgtctcagtgtctatcattaaactccaagcaggatcaatgaaggccctacaataggtttttttttcttgttacttcaaaaacaatcttacaaagttattttcttgagagttccatatgtgtattgtatcctgatcacactccaaaccttctgctgttcatgccttatcatgtgaactatacctctgaacgtgggagtccaaattgtccatctgctccttaacgttacttctcataggtagtttagtcgttgtgatgagaaaagtaatgaaatggtaccagaaatggggttttgtcgcaataaacctactgtgcggtttcttggactttcaggactggtttgtgggaagaatgtggaaaagtttgaagcagcaggctagagaagtcctcagatggtatacgtcaatcttaattctggtagctcagaagtctttgccaaaaaggaacccattgggaattggactagatgccaggacatttgtgtacaagtcaaaagactggtgagggaaatttcaagacattcagactgtggcatggtggttatctccttctcatagctagaattatagagcaaattaggaaggagtgaggggtaagaagtgagagaacaaagatctgggaatgagtgccttcaaagacgaggtcggtgcaaagctgttaaagcgattagtgcactgagggaagccatgtactttccattgctgccattataggaacaagactacagccacgggcggctgcacagcatggaaagtaaaagccctttaaaggtctttcgtgtcaaaagttccagcaggtgccacagccactccagtggagtctgtgtgacaggaagctcttgtgcttcgtttctatgcagaacagaggcctgtgcctggaatggcttgtcctcctggaggtcctggcagtctccctgcaaaaagatggtgaccagggtctatgctttcagtggaattgccttctgtgttctagccttggtgatcttagcgattttaagcctgtcaacaatatctgattttaggaatatagcagggtgggcagatgatcatgtatctttagatgtctcaggcactgaaataaataaatgtctcacaccatcatggtcctgatgaactcaatggctgcaatgaattcaactgctgtatccattagttcccagaaaataggagagaaattaattgcagttactaagaacatgactgttccagaaaaatctttccccccttttgggaaagttttgtttagcatgattcagaatagtaatgattcttttaaaaaagatcatagacaacttccaacaagttgaacaaacttaacagagttaactatggttacttttgcttccttactattctgaggggccataaatataatagagtttaaactttattaaaacaaaggtaaatgatgaatacatacctggtgcccaccagtctggcagtataactgcagttttctaaactattgttttcagctgagaattgttttctagactgtatgttccgctttcctccttgcaagggacatttggtgaggagatgaataagagctagatgattgccaattatgatgtatctgttctaactgtttaagtctatgccaaaaagtaaagctttttacaacaacac

SEQ ID NO: 2062 - DNA, 546 bp, Rattus norvegicus
  Genbank Accession No. NM_019341
atgtgtaagggactggcagctctgccacactcatgcctggaaagggccaaagagatcaagatcaaattgggtattcttctccagaagccagactctgctgttgaccttgtcattccatataatgagaagccagagaagcctgccaaggcgcacaagccctcgctggaggaggtcctgcaatggcgccaatccctggacaaacttctccagagcaactacggatttgccagcttcaaaagtttcctgaagtctgaattcagtgaggaaaaccttgagttctgggttgcctgtgagaattacaagaagatcaagtcccccatcaaaatggcagagaaggcaaagcaaatctatgaagaattcatccagacagaggcccctaaagaggtgaacattgaccacttcactaaagacatcaccatgaagaacctggtggaaccttcccctcacagctttgacctggcccagaaaaggatctacgccctgatggagaaggattctctgccccgcttcgtgcgctctgagttttataaggagttaatcaactag

SEQ ID NO: 2063 - DNA, 1854 bp, Rattus norvegicus
  Genbank Accession No. NM_019358
ggagacataaattgccgactgtgctgagaagttgccagttgccaagtttgctgtgcttgctccctccgctcgccttgaaagcccgggcactctctgtcgctgggactcttgctcaccgcttgccagcctcctcagagctcttctcggctgggcctgtggcttcgaagtttttttgttttttcatcttttcacaacccacaaaaaccactagctgctgaggctccaacgagatcaagatgtggaccgcgccagtgttgctctgggttttggggagcgtttggttctgggactcagcgcagggaggggccatcggtgcgctagaagatgatcttgtgaccccgggtccaggagatgacatggtgaacccaggtctagaagacagaatagaaaccacggacactacaggagaactggataagtcaactgccaaggcgcctctggtaccaacacagcctcccattgaggaactgccgacctcaggaacctccgaccacgatcacaaagaacatgagagtacgaccactgtcaaagcggtgaccagccactccacggacaagaaaacaactcaccccaatagagataacgcaggcggtgaaacgcagaccacagataagaaagatggcttggctgtagtgaccctggtcggaatcataattggcgtcttgttagccattggcttcattggagggatcatcattgtggttatgaggaagatttctggaaggttctcgccctaaagagccaaacagaactggttgttctcccaacacatctgaaaataagagagcttccaccttgccctgttccccatccctcttcctgtggaggaagatgacccatggaatgcccacccacccctctcacagccatggtgacccctccacttgccagcagtaccaaaggaaagatacgggacaagccactggcccctcgaaccatctgcgtttggaaatcaaattttttaatataaatgttatgattgaggaccacatgcatagaaaaatggtgcaaaaaccgagacagtatcatcagctttatcaactgtaaccatgggttggttcttccgggccagtcccagtctgttaagaggcaaaagaatttggaaaatgttacctcacagaggcacgggtctttttgcagttgccaacctgcaaatgcagttgatgcatacatattccagcctagtggggtctgaatcagtgcattgaaagtataaacccaaaatcaggcgtgataggcagcccctcagggagcttcattataccttttcagaagcatccactgccttcagttcccggaagataccttgctttttacaagcctccaaaccctctctaagcctcagatgactcaatgacccagaggtctgtctactccactccccctggtgatggaaagcccaagttgaggaaccatgtcctcacctccctaggcctcaagccttcagatcaaccgcttctttctggacgatggagacctcatcccagatgctcagaaagtttgttggatgtcacaaaatgccagagcctcagccgctgtcgaaccaagaacgaaactcagtccttaagtggaagtgactcctgtgcctgctttaggctaggaaatgagaccaaccagtttctagcacctgccttctgcttcccaggaaagacggagaaaaaaataatcttgtatgttcttaactgcttctaggtggtggatggaaaggtttgatgttaatttccggtcttcgtgacataccacatcttcccatgaggactcggtgttgctggcacaagagctgtagtgtcttggttacctgtgttggtactcaatacagtgtagacatcttttcaaataaaatatgattgtgtg

SEQ ID NO: 2064 - DNA, 1932 bp, Rattus norvegicus
  Genbank Accession No. NM_019359
agcagagcagtcggtcccactccagtgcgacccggagcctctgcgggactcgagtccgagcgaacctcgaagcatcatccgcgtccgtctgccgcgttccggcttctgcgccgcgcagagtagcgagcttgtgcatcacccgcgcggccacagctgggggctaagagcagggacaccgagggtgactgaccccgactccgagcgcagccccttcctgtggtccgaacagccatgacccacttcaacaagggcccttcctacgggctctccgccgaggtcaagaacaagatcgcatccaagtatgaccagcaggccgaggaggatctgcgcaactggatagaagaggtgacaggcatgggcattgggaccaacttccagctgggcctgaaggacggtatcatcctctgcgaactcataaacaagctacagccaggctctgtgaagaaagtcaacgagtcctcactaaactggccgcagttggagaacatcggcaactttattaaagccatccaggcttacggtatgaagccccatgacatatttgaggcaaacgacctttttgagaatggcaacatgacccaggttcagactacgctggtggctctagcaggtctggcgaaaacaaaaggattccatacaaccattgacatcggcgttaagtacgcagaaaaacagacacgacgcttcgatgaaggcaagctaaaggctggccaaagtgtaatcggtttacagatggggaccaacaaatgtgccagccaggcgggtatgacagcctatgggactcggaggcatctttatgatcccaaaatgcagactgacaaaccctttgaccagaccaccatcagtctgcagatgggcaccaacaaaggagccagccaggctggcatgtcggcaccgggtaccagaagagacatctatgaccagaagctaacattacagccggtggacaactcgaccatttctctacagatgggcaccaacaaagttgcttcccagaaaggaatgagcgtgtatgggcttgggcggcaagtgtatgaccccaagtactgtgccgcacccacagaacctgtcattcacaacggaagccagggcacgggaacaaatgggtcagaaatcagtgatagcgattaccaggcagaataccccgatgagtatcatggcgagtacccagatgagtaccctcgagagtaccagtatggtgacgaccagggcatcgattactagagtcacacacaggagtgcagtattttagtccattgtttatccagtgagacccaagctagccttgagtaattcttatctcgtcttcctaaacactattacgcttcctgtacctttaaagaatgccttacgtacattcctttctccctttcctgcctcctccctaaattgccttctagtgctgtagcgagggaagcctacagcctaaccagtaactcgcgttggaagaagtgagaaggaacgctgtgcgagggcagccagctctttcgctggagatctataaaattttttacacttacacgtaaactggtattttcaaacaataggaaactatttttttcttttttacagtttagtatgtatctggcttgtacacggtagactaagaagttgatttgctaagtgtggtctttgccaagtaatctaacatgcagctttagaacctgacacgtggatgcttctgcacagtgttgtctgctaagttttaaataaagtcgtgatcagtgtgattcgtgattacatgtgtactcattctttcccgaagctgacaaggtctctcccgagtggcgctctaaaggcgcgtctacagaaatggccgcagacatgtaggtgtgggtggcgtgcctgcagacttcatttgtgccaatgtattactgtagagtcgctgttcccttcaactgtatttattgctgcatttctcagcataaactt

SEQ ID NO: 2065 - DNA, 418 bp, Rattus norvegicus
  Genbank Accession No. NM_019360
  misc_feature (1)..(418): n = a or c or g or t
gccatggnccttcaccttagggttacccatgatagcagaggcagaggacattggctaccatcagttccggtgctctgttgccgaaaccacagatgcgtggtcttctggccaagcgtctgcgggttcatattgttggcgcattcgctgtggccctaggagttgctgctgcctataagtttggcgtggctgaaccaagaaagaaggcttatgcagatttctacaggaattatgactccatgaaagattttgaagagatgaggcaggctggtgtctttcagagtgcgaagtgatttcagaatgcaaagaattctttggattgtgctccatagaagttcactgctgacctgtgttcctgaactatgaaacgtgaatatgtgggctaaggagtagtttctctcaataaacattaattatatgg

SEQ ID NO: 2066 - DNA, 1660 bp, Rattus norvegicus
  Genbank Accession No. NM_019367
cccgtggattcccgactaggtacaagtaaacagctggcggaacgaagcctccagacacaggccaggtgggagcatgccggggctatggaggcagaggcttccttcggcttgggctttgcttctcctgcctttcctgccgctgctgttgcccgcagcccccgcaccccaccgcgggtcctacaagccagtgatcgtggtgcatgggctctttgacagttcatacagcttccgccacctgctggactacatcaatgagacacaccccgggactgtggtgacagtgcttgatctcttcgatggcagagagagcttgcgacccctgtgggaacaggttcaagggttccgagaggctgtggtccccatcatggaaaaggcccctgagggggtacacctcatctgctactcccagggaggcctggtgtgccgcgcattgctgtctgtcatggatgagcacaatgtggattccttcatctccctttcttctccacagatgggacagtatggagacacggactatttgaagtggctgttccctacgtccatgcggtctaacctctatcggatctgctatagcccctggggccaggaattttccatttgcaactactggcacgaccctcaccacgatgacttgtacctcaacgccagcagctttctggccctcatcaatggggagagagaccatccgaatgccactgcatggcggaagaacttccttcgtgtgggccgtctggtgctgattgggggtccggacgatggagtcatcactccctggcaatctagcttctttggtttctatgatgccaacgagacggtcttggagatggaggaacagccggtgtatcttcgagactcttttgggttgaagactctcttggcccggggggccatagtgagatgccccatggctggggtctctcacaccacctggcactccaatcgcacgctctatgacgcttgcattgagccctggctctcctgaagacgtcctcagggctctccaggaattccccagcccagagatcaagtggtggccttctggcgtgcctgtgaccacctcgtcgctcccacactgccccacctccccaccagggctcccaaaccctcccctctgctcctctgtgaatgacaagtcctggtcccctacctcatgtcctcacttggggacgtctccatgctctccctttctgccatggctgaggttgggaagcaagcaccaggtttttaactgtggcttcaccgctgctgctgttgcttctccgggtctggctgtaccggaggagaacccagcccctgcccacctcaggggtcttccaggccactcaggacatttttagcttgttattcccatgcccctcttttctgtccctgtggccagcctccccaccgagaggggcgcccgtacaagggggttctgaggctcccctatggggacagttccacttttgaagtgtcagtgttggggaatatctgtggcctgcaaggcccatctcaggtttggggatcccccagtccctatgatcagtgttggggtatcccctgggagcctaggttctttgaggccccagcccctcttttaaccacccttgagtgggtggtccccgtatttatagaaataaaagttccatttccacagaaaaaaaaaaaaaaaaaaaaaaaa

SEQ ID NO: 2067 - DNA, 2825 bp, Rattus norvegicus
  Genbank Accession No. NM_019371
ggatccaggttttcaagtttgttaggggatttaatgcaaatcaatatgcaaacagagagcattgtaaaaaaaaaaatccagtcctttctccggtcacacacaggttagctaatgtggagctcgcccagatgctctgcagcaccagctcaaggggaagggccaggaggagggcagtcccgggggcgggaccatgacgttgaggtcaaggcggggcttcctctcgttcctccccgggctgcggccgccgcggcggtggctccgcatctccaaaaggggccctccgacttctcactgggccagtccggcgctgggtggcagaactctacactactcctgccggtctcagagcgggactcccttctcttcagagtttcaagcaactttccccgcctttgcagctaaagtggctcggggaccgtggctgccgcaggtggtagagcccccggcccggctctctgcatctccgctgtgcgttcgctctgggcaagccctcggtgcgtgcaccctgggggtcccccgcctcggctctgtgagcgagatgcctctgggacacatcatgaggctggatctggagaagatcgccctggagtacatcgtgccctgtctgcacgaggtcggtttctgctacctggacaacttcctaggcgaggtggtgggcgactgcgtactggagcgagtcaagcagctgcattacaacggggccctgcgtgacggccagctggcggggccccgcgccggcgtctccaagcggcacctgcgaggcgaccagatcacgtggatcgggggcaacgaggagggctgcgaggccatcaacttcctcctgtccctcatcgacaggctggtcctgtactgcgggagccgcctgggcaaatactatgtcaaggagcggtccaaggcgatggtggcttgctatccaggaaatggaacaggttatgttcgtcatgtggacaaccccaatggtgatggccgctgtatcacctgtatctactacctgaataagaattgggacgccaagttacatggaggggtcctgcggatatttccagaaggaaaatcatttgtagcagacgtggagcccatttttgatagactcctgttctcctggtcagaccgcaggaatccacatgaagttcagccctcctatgccaccaggtacgccatgactgtctggtacttcgatgctgaagaaagggcagaagccaaaaagaaattcaggaatctaactagaaaaactgaatctgctcttgctaaagactgacggtggtgtgaagtccgctgggcgcattcgtttagtgacagttcctgaaatgttaagtgtcaagatccaaagactctgtccaatcccctgcctaccgcctgcatcgtttggctccctaccttgtttgtggtacttcgtgttttcttgctgggaatgcgttgccctccagacactctctttgccggatgaactcatttgctaactccagaaacacctgcagacatcctagctggccagcggtttaacggatagatctgggaatggatagatatgggaatgcagctgttcagcccaggattgcctcgtgttcgcactttatgcatacttcctggtctgataggaggaggtttgcgaagaaataaactggtgacagatgccacaaagaggcacccttgaaaccctaacagcaagaaagagaaagatctgaactatttccagatgttgttaacccgagactggacgattacggacaacctgatgacattatcgcctctagaaagggctgctgtcatagcgatcgatttataagtgtcccacggtggatgctcctttttcctggtcctacaacctgttctttttgaaggtcattgctaaattgatgctctcttgtcgaagacgaccccagcctgtatgctccatttttacttcttacttggggatcctaattatccagagaataaaactcaccaggtagtttgggttgttttttctggtactgaaaatttgaagttaaatgagagggacaggaagcgtcctggtaatttagcttctgctaactctgtgggaagagcaaagcctagcggtatgcgataaccatgcatacggtgagcagttcgagagggagatgtggttggaagtgcagacagccccctttcatcatgttccctttagctgttcttcgttcatggctaagaacagcatgttgtactcttaaaagatatggaaataaaaagacctcaaagctatcgagttctcccacattgtctgctctgccagcctcgctttagccgtcttgatccttgagagcaactggttggaagtgcatccagtggtgtggaatttcctagaactgtgggaggtttctcctgcaggatgcaggtgccgcttcccccagaactctgtacgaaacacccattttacggaagttagccatcctagttttcgctgctacttccccatctttcgaacctctttaatttccttgttagaatcccacaagcagcacagacccgagagtgttttatttcatcgtgttcagccatgcagactttccaagcaaagaagttgatacttctttcttctttcgggaaagtgtccaggaagaactgtcattcctccccccatggctctgttttgttttatttcccaccttctaacttacaacgtcatttccttatttattatgtttattgtcttgtagcctatgatgtctagagtgttaaacacaacgaaggcagggatttgtacgtttttgatccatgcagcatgttcccagcacctaagctaacatacagtaagcaacggcttaccaaacacatgttcaataaactcagtctcctctgtaaaa

SEQ ID NO: 2068 - DNA, 747 bp, Rattus norvegicus
  Genbank Accession No. NM_019374
atggcgtggtccaggctgatgctggcagcttgcctccttgtgatcccctctgaggttgcagcggactgcctgtccttgtgttccctgtgtgcagtgaggacgcaggatgggccccatcccatcaaccccctgatttgctccctggagtgccaggacctggtgccgccctcggaggagtgggagacatgccggggcttttggtcttttctcaccctgactgcctctgggctccatggcaaggatgacttggagaatgaggttgctttggaagaaggctacacggcactgaccaagctcttggagcccctcctgaaggagctggagaaaggccaactccttaccagcgtctcagaggaaaagctcaggggtctctccagcaggtttggcaacggaagagaatctgagctactgggcactgacctgatgaatgatgaagccgcacaggctggcacgctccatttcaacgaggaggacttgagaaaacaggccaaacgctatggcggctttttgcgcaaataccccaagaggagctccgagatgactggggacgaggacaggggccaggatggggatcaggtagggcatgaggacctgtacaaacgctatgggggcttcctgcggcgcattcgccccaagcttaagtgggacaaccagaaacgctatggtggttttctgcggcgtcagttcaaggtggtgactcggtcccaggagaaccccaatacctattccgaagatttagatgtttga

SEQ ID NO: 2069 - DNA, 2369 bp, Rattus norvegicus
  Genbank Accession No. NM_019380
  misc_feature (1)..(2369): n = a or c or g or t
gggacgggggaaggacggagctcggccgctgctgcctccctcgttcactccctcgcgctctcgcccgccccctccctccctcccctcccttccccgggcccgggcccggaccattcgctgctcgctctccggctagggaggatgtcgggctcgtcgctccccggcgccctggccctctcgctcttgctggtctctggctcgctcctcccagggccaggcgctgctcagaacgctgggtttgtcaagtcgcccatgtcagaaactaagctcacaggggacgcctttgagctgtactgtgatgtggtcgggagtcccacgccagagatccagtggtggtacgcagaagtcaaccgggcagagtctttcagacagctgtgggacggtgctcggaagcgccgtgtcaccgtaaacaccgcctacgggtcaaacggcgtgagtgtgctgagaataacccggctcaccttggaggactctgggacttacgagtgcagggcaagcaacgaccccaaacggaatgacttgaggcaaaacccttccataacatggattcgagcccaggccaccataagcgtccttcagaaaccaagaattgtcaccagcgaagaggtcattattcgagacagcctccttcctgtcaccctgcagtgtaacctcacttccagctctcacacccttatgtacagctactggacaaagaatggggtagaactcactgccacccgtaagaatgccagcaacatggaatacaggatcaataagccaagagctgaggattcaggcgaataccactgtgtatatcattttgtcagcgctcctaaagcaaatgccaccattgaagtgaaagctgctcctgacatcactggccataaacgcagtgaaaacaaaaatgaagggcaggatgctatgatgtattgcaagtctgttggctacccccacccggaatggatgtggcgcaagaaggagaatggtgtgtttgaggagatttccaatagctctggtcgcttcttcatcatcaacaaggagaattacactgaattgaatattgtgaatctccaaatcacagaagatcctggagagtatgaatgtaatgccaccaactccattggctctgcctccgtttccacagtcctcagggtacggagccaccttgccccactttggcctttcttgggaattctggctgaaatcatcatccttgtggtgatcattgttgtgtatgagaagaggaagaggccagatgaggttcctgatgccgggccaatgaaaaccaactctaccaacaatcacaaagataaaaacttgcgccagagaaacacaaattaagtactgcttttaatctctttaggttcctgaaaaatgatggcaacatgacctgctaagttttctgcttggacctctttggtctctccctttcaagtgagcaacaccacaatgaccgtctaaagcatgccttatttagcctctcctataagggtgacctagccaggtacattttaaacaatgcttcagtgtagaaggtgtaaactattttggggcttgatgtgctgtgaatgttgctttccctccctttgttaaaatatttaaatagaagcgaaaggtcctttgaggatcagatcatgcatgcgccatttttttacttatacagctgttaaattggcaaagctctaaatgcactgctgccatctagtgatcattttgnaaagtacagcaaaacctacagatatatacagtatataaatatatatatattcatatcncngggggtgggagaaatccaaaataaagtcaaagcttgtttcatttttaagctgctgatactcattccttattatttgttgtcagatgaggaagctgcagttctggtacaaaaagatgagagtataaacttaagtctgtcattctaagggcttacttaccctataactttaagaacctggaacagtccactgaacggctagaatgaattgcagtatatatgtatgattgctttttaagtgactatttttccttttgtcaaatcatgtaaattctgaaatcttttgcactgatgtgtcgaaccttattcttgtatattcaatcaaggcaacttttataatttcccatttgttttcaatgaccctgaaatgttaatagcatggtgatattctatgcaactctagttataccttttggtttgacactgtattttcacattgatttcatgactgatgatagattttataacctgactgggttctcatgcggtactaactgtagatgcatgtacttgtgttctgtgtaattattgaagtgcaatggtgtacaaaaaaagtgaattcacctgtttttaacaataaaacattgataaaaaaaaaaaaaaaaaaaaaaaa

SEQ ID NO: 2070 - DNA, 2493 bp, Rattus norvegicus
  Genbank Accession No. NM_019385
acggccatggggctaggggcaagcagcgagcagccggcgggcggcgagggcttccatctgcacggggtacaagagaactcgccagcccagcaggcgggcctggagccctactttgacttcatcatcaccatcgggcactcaaggctgaacaaggagaatgacacgctgaaggcactgctgaaggctaatgtggagaagccggtgaagctggaggtgttcaacatgaagaccatgagggtgcgagaggtggaggtggtgcccagcaacatgtggggcggccagggcctgctgggagctagcgtgcgcttctgcagcttccgcagggccagcgagcacgtgtggcatgtgctggatgtggagccctcttcacccgctgccttggccggcctgcgcccttacacagactacattgttggctctgaccagatcctccaggagtcggaagacttcttcactctcattgagtcccatgagggaaagcccctgaagctgatggtttataactctgaatccgactcctgccgggaggtgactgtgacccccaatgcagcctggggtggagagggcagtctggggtgtggtattggttacgggtacctgcaccggatcccaacgcagccctccagccagtacaagaagccacccagtgcctcatcacctggcactccagctaagaccccacaacctaatgcctttcctcttggtgccccaccaccttggcccatccctcaggactcttctggcccagagctgggttccaggcagagtgactacatggaggccttaccacaggtccctggtggctttatggaagagcagctccctgggcctgggagtcctggccatggcactgctgactatgggggatgcctacattccatggagatcccgcttcagcctccacctccagtccagcgggtcatggacccaggcttcctggatgtgtcaggcatgtccctcctggacagcaacaatacaagtgtgtgccccagcttgtcatcttcctcattgctgacccctacagctgtttcagccttaggaccagaggacattggttccagcagcagttctcatgagcggggtggtgaggccacgtggtcagggtcagagttcgagatctccttccccgacagtccaggctcccaggcccaggtggaccacctgccccggctgactctccctgatggcctcacgtctgcagcttcaccagaagaagggctgtctgcagaactgctggaagcacagaccgaggaaccagcacacacagccagcctggattgcatggcacaaactgaggggccagccggccaagtccaggctgccccagatccagagcctgggttgtgtgaaggcccctggtgacatttggtgttccttagctgtgtagctctctaggctgcagcctctaacgaggcatgggctttgctagagttcacatgtagtcctggattgaaaggaacagaacactggagcaatgtccggcttctatagaggcaggagatggatctagatgtgtctgtgaagcactggcaccttcccgggagggagaggctgcaggcccgacacaatgtccatatgaagatggggtgggggacaagaggctgtgtccacaagcggccacactggtacagaggagcaccccgaatcccaatgcccttcctcattctaatccttacactggatgagaggagcagtatacttggccacttgatttctaggatggaagattctgggcccttcagagggacctgcctctgctagctgtacactagcctcaggggaggtggaagggagcagacactccagttcttctctcctgtgatctctcagccctccctcacgtgcggacagcaggctccgagtacacaaggtacagctggttctgatggtaaacaggtcaggctttgcttaccatcaaccccccctactcagcccttttcgtctggaacttctgggtaaagccccctcccatctgtcctcagtgtacgggaaaggggccttgagaggctcaggttctgagaggacgtctgtgctggtgccttagtgcagatggcaccagccatgtgttgtgcaggtccagtcctgggtccttggtaattgtgtcccacctccacagaccatggagctgcctaggttgttaagccaaggattctgtttaggaagcacagggcaagtagtacagtgggcggacaggaccccatgcagtaggaatacatttatagccgggcccgtgaggcccccagagccactgaggcctgcagttgtacagcatgggttaccacagggctgctttgtggtgagcaccctgacccccagctgtccttgctggaggggtttgctccctgggacaccgtaagtggggtgagatggatgctgatgctgtttcaagagtgaaccccagatgtttctttccctgtaatttgctgtgggaagtgacaagtgaccgaataaacaagtccagcacgaaaaaaaaaaaaaaaaaaaaaaaaaaaa

SEQ ID NO: 2071 - DNA, 3393 bp, Rattus norvegicus
  Genbank Accession No. NM_019386
ctggcccatggcagaggagctgaacctggagaggtgcgacttggagatacaggccaatggccgtgatcaccacacggccgacctgtgccaacagaaactggtgctgcggcgaggccagcgcttccggctgacactgtacttcgagggccgtggctatgaggccagcgtggacagacttacatttggtgccgtgaccggcccagatcccagtgaagaggcagggaccaaggcccgattctcactgtctgacgatgtggaggagggatcctggtcagcctctgtgctggaccaacaggacaatgtcctctcgctgcagctctgcaccccagccaatgctcctgttggccagtaccgcctcagcctggagacttctactggctaccaaggctccagcttcatgctgggtcacttcatcctgctcttcaatgcctggtgcccagcggatgacgtgtacctagattcagaggcggagcgccgggaatacgtcctcacacagcagggcttcatctaccagggctctgtcaagttcatcaagagtgtgccttggaactttgggcagtttgaggatgggatcctggatgcctgcctgatgctcttggatgtgaaccccaagttcctgaaggaccgtagccgggactgctcacgacgcagcagtcccatctatgtgggccgcgtggtgagcggcatggtcaactgcaatgatgaccagggtgtgcttctgggtcgctgggacaacaattatggggacggtatcagtcccatggcctggatcggcagcgtggacattctgcggcgctggaaggaacacggctgtcagcaagtgaagtatggccagtgctgggtgtttgcggcggtggcctgcacagtgctgcggtgccttggcatccctaccagagtggtgaccaactacaactccgcccacgaccagaacagcaacctgctcatcgagtacttccgaaacgagtacggggagctggagagcaacaagagcgagatgatctggaatttccactgctgggtggagtcctggatgaccaggccagacctacagccaggctatgaggggtggcaggccattgaccccacaccgcaggagaagagcgaaggaacatactgttgtggcccagtctcagtgcgggccatcaaggagggtgacctgagcaccaagtatgatgcgtccttcgtgtttgccgaggtcaacgctgatgtggtggactggatccggcagtcagatgggtctgtgctcaaatccatcaacaattccctggtcgtggggcagaaaatcagcactaagagcgtgggccgtgatgaccgggaggacatcacctatacctacaagtacccagaggggtccccagaggaaagggaagtcttcaccagagccaaccacctgaacaaactggcagagaaagaggagacaggggtggccatgcggatccgagtgggggatggtatgagcttgggcaatgactttgacgtgtttgcccacatcggcaacgacacctcggagagccgtgagtgccgcctcctgctctgtgcccgcactgtcagctacaacggcgtgctggggcccgagtgtggcactgaggacatcaacctgaccctggatccctactctgagaacagcatcccccttcgcatcctctacgagaagtacagcggttgcctgaccgagtcaaacctcatcaaggtgcggggtctcctcgtcgagccagctgctaacagctacctgctggctgagagagatctctacctggagaatcctgaaatcaagatccggatcctgggggagcccaagcagaaccgcaaactggtggctgaggtgtccctgaagaacccactttctgattccctgtatgactgtgtcttcactgtggagggggctggcctgaccaaggaacagaagtctgtggaggtctcagaccctgtgccagcaggagatgcggtcaaggtgcgggttgacctgttcccgactgatattggcctccacaagttggtggtgaacttccagtgtgacaagctgaagtcggtcaagggttaccggaatatcatcatcggcccggcctaagggacccccttcacccagactcagcccatcacctgccagccctcaactcaacctggttttatccccagataatgagcgacgactgcaccccattcgggctgacatgactgcctcggggcttttcagaagacaatgtacttctggcccatcctgttcctctggatctatttccccatctgtccccttagctgtgaggaatgttctgtgctgatacagccagtaccctggcgagagtaagaggagagccattattaccagcactctgtatctgtgtattgtttgaactgtctctagagcctcagagtgagtgcaaacggatggtgagcccgttggctcaacgaaggaactcagctgcctctccaacagtttcccacccgcctcccctctgaaggggaactgtatgtgctaggcaccttgagttctaacagggacagcaacctgttggatgtccatgagaaacttcagggtgggaactgaggctgcccgtgctgtactgtgtcagtaggacaggccagccatcacttgcagggccagtgggtgagcttagaaacaccacctgtgtcatctggcttggaatttagcactctatctgtgacaccagctttgacccgagggtgtcagagaggccatctcttccggccttctccggaaggacacggttagggtgaggaggtgagggaggagcggggaggcttgagagctgggagtcagagcctgggtttaagccccaaggagggctacactctatcctcctcttctgggcttgatcctcctatatcagagcagagattgacaagccctcctccagggtttcctggtcccatacttctaaagccttccatccaaggctagggcacttctggggtgtcctgcttctcacctgtgcctgggctcctcagatacagttccaggacaacccacaagctactcacatagtgcctagactagatttcacagaaggagccttaaatgtccatgctggtccctacccaccagggccacccctccatgcccctcctccttggtaagcacacctagacacagcatttgtctctagaaaagcacagaagcctatgggtcatcatccgagttagcctactcctacccctctgtggctgggccctcaagctggaaggctgcagtgtggaggggtttctagggggtgaggtcagagactctgggatcccctgaaatcccagagaagaacttgggaagaatcacactgctgcatttaacacgttccgctttatgcagagaatcgcaccgtgagtcttgtatctgccctgtccccacacggttccatttcttttgatctgtgcaagctt

SEQ ID NO: 2072 - DNA, 1940 bp, Rattus norvegicus
  Genbank Accession No. NM_019620
ggaattcggcacgaggtgatttccagcttttggaagccccggtgctttacgaaatcacggtagccggagagccatggagatggaacagttgaccttccgagatgtggctgttgacttctctccggatgagtgggaatgcctggaccctcctcagcagaggctgtacagggacgtgatggtagagaactacagaaacctggtctctgtggctctttctcatcattgtacccagaacttttcaccagaacagatcctaaaatattccttcacaaaaggaactaatggaagttgtggccttaaaagtttatacttaagggaagattgtatatatatagatgagagtaaagcccaccatggtagagatatgcaatgtctaattacaagcaataccaaagatgtcattgacagcagagatcaagaacacaaaaccgctctgacaataactcctgtgaggccagatactttggatgagccaagtatctataactgtaaatatccacaggaaagttttcagcatgacttaactttgaaagaaagtttggaagatctgatagatgggttaatgtttcacccaaacagttccatagataaagaattaagaagcagaggactgatatcaacaagtgatcaaattgagactttctatactgaaagatccttactcttcagtcagcaaatagctatctcctatgacccaaagcacaattctattgattatggattgcctgctattgatccattatcacatagcccaaatggcgatacagatgtgtgggaaagccctttcatgtataaggaaactagcaaagattttagtagtgaatctttactaaataactgcaatgatattatcttagagaaatctagtcagtataacaaaatatgtaacgactttgaccattgctcaagtcccaacaaatatcagtatactcttccaaagaagcctttcaattgtgataatttctttactcaatgttcaaagctttctatccatcaatatgttcaagataattgttacaagagtatcgattgtgacacaatgtttaataaaactttaaatgttattacacataaaattcagcattcccagaaatcctacaaatgtaatgaatgtggcaaagcttttaaatattgctcaagttacagaaaacacagaataattcacacaggagaaaaacccttcaaatgtaaagtatgtggaaaatcctttacccaatgtgcaagccttaaaaaacatcagagaatccacacaggagagaaaccctacaaatgtgaagaatgtggcagaagctttaaccactactcaattcttggtcagcaccagaggattcatacaggagagaaaccctacaagtgtaaacagtgtgggaaatcctttactcaatgttcaagccttcagaaacaccaagtaatccacactggagagaagcccttcagatgtgcagaatgtggcaaatcctttacgcaaaactcaacccttagtcaacaccagagaattcatactggagaaaaaccttacaaatgtgaacagtgtggaaaggcctttacccaatgttcaagccttagaaaacaccagagaattcacactggagagaaaccctacaaatgtgaagaatgtggcagagcctttaactgccgttcatcttttactaaacacacaagagaattcacacaggagagaaaccttacaaatgtaaagactgtgacaaagctttcatccactgcacaaaccttactcaacaccggagaatccatacaggagagaaaccatacaaatgtaatgaatgtggaaagtcctttagtcagtgttccaaccttagaaaacatgagagaattcatacatgagtaaaactaacaaatgtaaagaatttagtaaatcttttatccatatgcaaaaaaaaaaaaaaaaaaaaaaaaaaaaaaaaaaaaaaaaaaaaaaa

SEQ ID NO: 2073 - DNA, 1395 bp, Rattus norvegicus
  Genbank Accession No. NM_019905
aggctctctgcaataggtgcccggcccagcttttttttcaaaatgtctactgtccacgaaatcctgtgcaagctcagcttggagggtgatcattctacacccccaagtgcctatgggtcggtcaaaccctacaccaacttcgacgctgagagggatgctttgaacattgaaacagcaatcaagaccaaaggcgtggacgaggtcaccattgtcaacattctgactaaccgcagcaatgcacagaggcaggacattgccttcgcctaccagaggaggaccaaaaaggaactgccatcggcgatgaagtcggccttgtctggtcacctggagaccgtgatgttaggcctgttgaagacacctgctcagtacgatgcctctgagctcaaagcctccatgaagggcctggggactgatgaggactccctcatcgagatcatctgctcaagaaccaaccaggagctgcaggagattaaccgagtgtataaggaaatgtacaagaccgatctggagaaggacatcatctctgacacatctggagaattccgaaagctgttggtcgcccttgcaaagggtaaacgggcagaggatggttctgttattgactacgagctgattgaccaggatgcccgggagctctatgatgctggggtgaagaggaaaggaaccgatgtccccaagtggatcagcatcatgactgagcgcagtgtgtgccacctccagaaagtgttcgaaaggtacaagagctacagtccttatgacatgctggagagcatcaggaaagaggtcaaaggagacctggagaacgccttcctgaacctggttcagtgcattcagaacaagcccctgtactttgctgaccggctgtatgactccatgaagggcaaggggactcgagacaaggtcctgattagaatcatggtctctcgcagtgaagtggacatgttgaaaatcagatctgaattcaagaggaaatatggcaaatccctgtactacttcatccagcaagacactaagggtgactaccagaaggcgctgctgtacctgtgtggtggggacgactgaagggcttggcatggtggattgcccagaagtggccctacctgtgccccaacctaatgttctagagaatcagcctgccactaatggacccctgaactcctccctgtgaagatgacgacagagctgccgacccatcccccatcttagctgcctttgcctggctttcccctcattctctcctttatgccaaagaaatgaacattccagggagttggacgtaccgtctgtgacatgagacacttcctcatatgtgtcgtgaataaaccatttttactttaaaaaaaaaaaaaaaaaaaaaaaaaaaaaaaaaaaaaaaaaaaaaaaaaaaaaaaaaaa

SEQ ID NO: 2074 - DNA, 1435 bp, Rattus norvegicus
  Genbank Accession No. NM_019907
tgatgtattttggcagctgctcctgctttgcgggttgagggggacaggacgacccgtggaaggatggtgtgtgaaaagtgtgaaaagaaactcggcagggttatcactccagacacatggaaggacggggcccggaacaccacagaaagtggtggaaggaagctgaacgaaaacaaagctctgacttcgaagaaagcaaggtttgatccatatggaaaaaataagttctccacttgcagaatttgtaaaagttctgtacaccagccaggttctcattactgtcaaggctgtgcctacaagaaaggcatctgtgcgatgtgtggcaaaaaggttttggatactaaaaactacaagcagacttccgtctagtctgttgaagattccaactctacggttgtatttgtgcttcagcttttcaagcgtaacacggatgtccatctcacaaaatgacctgtttgaggatgaatgattcagtctgaagcagggacgttgatcagtattgatctgtctgctctcatgaagttgtgaatgaagtttctgccttaggtggttattttccttgtgagcattttactgaactagataagtgacaaaattaatgaacgaggtttcccaacttgtgtacgcactgtctactcgacattatctaattaatgagtacgcactgtctactcgacattatctgtataattaatgagtaaggtgttccctacttctgtacgcactgtctactagacattatccatataattcctatctgacccacgcgttttatttatagatattgcaaatgtgaaatcactgattctttgctctgaacttgacatccagacttgagatttctcactttctcacaaacattgcagttcttagaacaaacagggccttagttactgcattttcatgagctataatgtctgagaccatttttgcagagtggttccttggtgaccagtcctgccacaagtctaagataagttgcatttttatttaaagttgctgttgctgctaaagtgagtttcttttacgtgtgactgagtgccatggggcccgatgtccaggcagacactgaagttcagagacgtgcgttctgtcagcattatcttaaattcaaatgagaatacatttattctgtttgggaatgttctttgaagaaggatacatagctttccttaacaccccccaacccccgctgccacttcctcagaaataaagcaggcctctggcctctgacattgctgcagcctgccagggggctgctgtgaatgaaggtttttcttgttgccttctttgggttgggccttccacctttaaaaccctcagcctacccagagaccaaaagcatattctctgtttttatctgcaggatcttaaatgcatatcactgtgtaatgtgagacctactataaacaatgaaaaaataaaaaaaaaaaaa

SEQ ID NO: 2075 - DNA, 3504 bp, Rattus norvegicus
  Genbank Accession No. NM_020075
ctctgcttttctctttcagagctgttgcgcagccattggtacctgtattggggaaacatagcatacaagcaagaagcttacagcctcagtggcgaaaaatttttcatgtcagagaccgagaactcttgcagtcgtttatgtcatcccttcttctccagacagaagataccaaaaagttgcaatcaaagatctgttcatcttattgataaagtcactaataagccaaaatgtctgtcaacgtcaaccgcagcgtgtcagaccagttctatcgctacaagatgccccgtttgattgctaaggttgagggcaaaggaaatggaatcaagacagttatagtcaacatggttgacgttgcaaaggcgcttaatcggcctccaacgtatcccaccaaatattttggttgtgagctgggagcacagacccagtttgatgttaagaatgaccgttacattgtcaatggatctcatgaggcgaataagctgcaagacatgttggatggattcattaaaaaatttgttctctgtcctgagtgtgagaatcctgaaacagatctgcatgtcaatccaaagaagcaaacaataggtaattcttgtaaagcctgtgggtaccgaggcatgcttgacacacatcataaactctgtacattcattctcaaaaacccacctgagaatagtgacattggtacaggaaagaaagagaaagaaaagaaaaatagaaagggcaaggacaaggaaaatggctctgtatccaccagtgagacaccaccacctccaccaccaaatgaaattagtcctccacatgctgtggaagaagaggaagatgatgattggggggaggatacaactgaggaagctcaaaggcgcagaatggatgaaatcagtgaccatgcaaaaggtctgacacttagcgatgatttggaaagaactgtagaagagcgtgttaacatcctgtttgattttgttaagaaaaagaaagaagagggcattattgattcatctgataaagacattgtggctgaggcagaaagactggatgtaaaagccatgggccctctcgttttgacagaagttctctttgatgagaagataagagagcaaatcaagaaatacaggcgccattttttaagattttgtcataacaacaaaaaggcccagcggtaccttcttcatggtttggaatgtgtggtagcaatgcatcaagctcagttgatctccaagattccacatatcttgaaggagatgtatgatgcagaccttttagaggaagaggtcattatcagctggtcagaaaaggcctctaagaaatatgtctcaaaagaacttgccaaagagattcgtgtcaaagcagagccatttattaaatggttgaaggaagcggaggaggaatcttctggtggtgaggaagaagacgaagatgaaaatattgaggtggtatattcgaagactgccagtgtaccaaaagttgaaactgtgaagtctgacaacaaggatgacgacattgatattgatgccatttaaaaggatggatgcaacttagcttaacagtgtaatgctgcaaatttttctccattatcagccagaagtgcaacatgtatgtgcaagagctaaagtggcttaacatcatgctacacttgatactaaaaagctattactgtgagtggtctataattaagcccaatgagacatctagggagtccatacatatcagtgagcagttgtagtttgcttatttatagcatgtttctttcggaaaaactagtggtggacacatttggatcacatttatacagttataaaaaataaagatttgattttggtcattcttcagactttgggctatgaatggcttatgctgaagtaattggctacttttaggatgttacaccatttaataacttagacttcttaagtttggtagattgttaggtactgaagacttgaagaatgcaaacaattataatgaccttactcagccattaagaaatgaagtattttgaaagttgtgtctccagtccattgagattggcaactgacaattcttgtcattctaaggaaatttgatgatttaatgacagtgtgacatcctcatgagaagtaaaaatgacctgtgtgtcctatggtttaagagcaaattttgaaacttggagttgtggtttttcagtttgtgtacactcaccccaaattgtagtctattgagtcatgtgcattgcacgttggataagccagggaaatgacaaataagtattttgtgtgtatttagtggttgctttgtactgagagaaaagctttgaggtgtgattaaatcgtaaactctgattctatttgggagaaacaggaaaaaggtgcacttaatctaaaacagcataagttttcaacttttacccttaaattataatttcaagatgtttagacatactgtatcttgtgtttgatgtgttccccctccctaatattatggtttattctttaatgccttttaatttggatataatagcttgtactttagattttggttgctatcttgccaaaataagtgttactgtttttcaagcttgatccccttccctgattgtcttatttaaagagaaagttaaactcatacttctgagtcagagcctgtattttggttaagacttgggatattttttacttcacattgaatatagctggatacctgagaagtctggtgatggcactgggtgggtgcagctagctaaggcctgaccagcccattcagagccttggacttcagacacaaaagtgagtttcttacccacttgctggtgtaaactctatctggggtcctgactatatttgaatacttgtcttcaatattaaaaaacatagcacatttttctttctacaaaagtacattctggagttaagaacccatgtggttgatttgtgtgtggcgtgctagctcatacattatttggatcttattctttgtgtcatccatctcacagattataagactttgattaatgtaaaaagtatgcgttaaaatcataccaaacatttggtaaaattaaaaccttgatgggaggctgggcgtggaacaggagccatatacctggaatggtaacaggggaatgtgctatgtcacaccaaagaagtgggacttggaaagtcacttgtctcctgggtttcagactctttgttgcatgggcagcccatccatatgtcattactttttgagattctcaagtagatcagcacatttcggcctcaggttggcaagattttgtcttagagctgttgctttaaagggaaatggtcaggtcttagacacttaggaaggtcttgggcttctgttcattctggtgccaaaccagtgggattcaaatttcacacaatctgggtttttattcatggaggttaacctggtaagagtaatccttcatggctctattgaggtgtcttaaaaagtttcctgtttcaaacagctacattacttgattaaaacaatgttataaaattaaatttccccctcctttcatattaa

SEQ ID NO: 2076 - DNA, 4128 bp, Rattus norvegicus
  Genbank Accession No. NM_020306
ggttccggctgtgggcagcagggtggtccgcgactgcggccggaagcaggctgagcggctctcggcgagcgccgcctgtacttccggggacttcagcctagctcttgagttttccctgtaggcggcgcgggagggaaaagtttgcagggccgtgctgggaagatcacctccgcttcccaatgtgagcagtttctcgaacgctctctctagaaggttgcccagagaggtggtggacgggaacatgaggcagcgtctcctcttcctgaccactttggtgcctttcgtcctggcaccccgacctccggaggaaccaggctctggctcccacctgcgacttgagaagcttgattctttgctctcagactacgatatcctctctttatctaatatccagcagcactccataaggaaaagggatctacagtctgcgacacacttagaaacactactaactttttcagctttgaaaaggcattttaaattatacttgacatcaagtacagaacgcttttcacagaacttgcgagtcgtggtggtggatgggaaagaggaaagcgagtacagtgtgaagtggcaggacttcttcagcggacatgtggttggtgagcctgactctagggttctagcgcacataggagatgatgatgtcacagtaagaatcaacacagatggggcagaatataacatagagccactttggaggtttgttaatgatactaaagataaaaggatgctggtgtataagtctgaagatatcaaggatttttcacgtttgcagtctccaaaagtatgtggttatttaaatgcagatagtgaagagttgcttccaaaagggctcatagacagagagccatctgaagagtttgtccgtcgagtgaagaggcgagctgaacctaacccattgaagaatacttgtaaattactggtggtggcagatcatcgattttataagtacatgggccgaggagaagagagcactactacaaattacttaatagagttaattgaccgagttgatgacatataccggaacacctcgtgggacaatgcaggatttaaaggttatggagtacagatagaacagattcgaattctcaagtctccacaagaggtaaaacctggtgaaagacacttcaatatggcaaaaagttttccaaatgaagaaaaggatgcttgggatgtgaagatgctgctggagcaatttagccttgatatagctgaagaggcctctaaagtctgcctggctcatcttttcacctaccaagattttgatatgggaactcttggattagcttacgttggttctcccagagcaaacagtcatggaggggtttgtccaaaagcttattacaacccaggtgtgaagaagaacatctatttgaatagtggtctgacaagtacaaaaaattatggtaaaaccatccttacaaaggaggctgacctggttacaactcatgaattgggacacaattttggagcagaacatgatcctgatgggctggcagagtgtgccccaaatgaggaccaaggaggaaagtatgttatgtaccccatagctgtgagtggtgaccatgagaataataagatgttttcaaactgcagtaaacagtccatctacaagaccatagaaagcaaggctcaagagtgcttccaggagcgcagcaacaaggtgtgcggcaactccagggtggacgaaggagaagagtgtgacccgggcatcatgtacctgaacaacgacacctgctgcaatagtgactgcacactgaagccaggtgtgcagtgcagtgataggaatagtccttgctgtaaaaattgtcagtttgagacggcccagaagaagtgccaggaggctatcaatgctacttgcaaaggagtgtcttactgcacagggaatagcagtgagtgccccccaccaggagatgctgaagatgacactgtgtgcttggacctgggcaagtgcaaggctgggaaatgcatccctttctgcaagagggagcaggagctggagtcctgcgcatgtgctgacaccgacaactcgtgcaaggtatgctgcaggaacctttctggcccatgtgtgccttacgtcgatgcagagcaaaagaacttatttttgaggaaagggaagccctgtacagtagggttttgtgacatgaatggcaaatgtgagaaacgggtacaggacgtaattgagcggttttgggatttcattgaccagctgagcatcaacacttttgggaagtttctggcagacaacatcgttgggtctgttctggttttctccttgatattttggattcctttcagcattcttgtccactgtgtggataagaaactggacaagcagtatgagtccctgtctctgtttcatcacagtaacattgagatgttgagcagcatggactcagcatctgttcgcattatcaagccgttccctgcaccccagactccaggtcgtctgcaggccctgcagccggctgcaatgatgccgccagtgtctgcggctccaaaactggatcaccagaggatggacaccatccaggaagaccccagcacagattcacatgtggatgatgatggctttgagaaggaccccttccccaacagcagtgcagccgccaagtcctttgaggacctcacagaccacccagtcaccaggagtgagaaggccgcctccttcaagctgcagcgtcagagccgagttgatagcaaagagacagagtgttagtgggagcctgggcctgctctgggggacacagacctacagatgttccacagagctgacctgaatcaaaatagactgtaatgatctgagaaacgggagcagcttagcagatgctggtcatgtgacaggaccttcacatgacatcctgtgtatgtaggccctttgaagaggtgaggtaaatctggcttatttaaggctttcaggttttggggttttcttttgtaatctaaaaatctcctttgacctgtggtgcagaagcagaaaataaggctggatcaagttcctggtgacagcactgattaagccttcagtctgtttttctgtatgctgtaaggtcctctcactacggtgaagcacttagcagtgaggataactggaacacagactttttgggggttttggccttcacatgtgcgttgtctccaaatgccgtctgtcttggcactgaactttgtggatacagtcctttccaagatgaagactagctctggaacagtctatacaaacagccacatgaacttcaagatggcctattaactgcttagccccaggttccctggacagtttttccgttttgcaaaaagtgtcttcacgggtctctaaacattgtttgtcttaaaaaatactgggctggagagttggccccacagttaagagcacttggtttcattcccagtacccacacggtggctcttaactccaatcccaggggagatgacatcttctgaactctagaacacaaggcatgcattggtgcagtcaaacatgcaggcaacacacacaaatttagaaagccaagtgctgtaagaagttgcacatcccccaacctacagtgcttcgcggtctgagctggagtggagctctctcctgaacactctggaaggctggcaggtgctgagctggctagggagacgggtggggcccagccctggaagaaccgtcttcagcctcagcaagcagacactcgcgttacctcaggctttggggcttcaggacccaggatgttttgtacttattgtgtgaggataaataccattagcctgaattctcatttctgtaagttttagttataaaagctttttttcttctaagaattgcaatgtgctcaccagcaaacacgtcttaaccagaataacttgtaactctgaggacagttaaccaaacctgtgccttgtctctcctgagggtgtctgttacactaatacttgaacatgtaccttgtggtattggctccttttactagtcatgacagccttatatgttagttacactttgaggatttgctctaaggtgagtggggtgtgtgggtgtatgtatgaatgaaacagttggcagaatataagaaaaccatttttataaaattgtgactttttaaaacaaaaaaaaaaaaaaaaaaaaaaaaaaaa

SEQ ID NO: 2077 - DNA, 539 bp, Rattus norvegicus
  Genbank Accession No. NM_021261
cctcggcctccgggctgcgggaacgcccggactgggaacgccacgtcgagaggcgttcgcggaaggcgcgggatccaggacgtgctggtcacccccaaaccccaggccacccattatcgccttggttcgcccatcagagttgtaagaaaatggcagacaagccggacatgggggaaatcgccagcttcgataaggccaagctgaagaaaaccgagacgcaggagaagaacaccctgccgaccaaagagaccattgaacaggaaaagaggagtgaaatctcctaaaagcctaggaagatttccccaccccaccccttcatctccaagaaccccctcgtgatgtggaggaagagccacctgcaagatggacgcgagccacaagctgcactgtgaacccggcactccgcgccgatgccaccggcccgtgggtctctgaaggggacccccccactaatcggactgccaaatttcaccggtttgcccagggatattatagaaaattatttgtatgattgatgaaaataaaacacacctcgtggc

SEQ ID NO: 2078 - DNA, 348 bp, Rattus norvegicus
  Genbank Accession No. NM_021264
tatgtctggaaggctgtggtgcaaggccatttttgctggctacaagcgaggcctccggaaccaaagagagcacacggctcttcttaaaattgaaggtgtttatgcccgagatgaaactgagttctacttaggcaagaggtgtgcttatgtgtacaaagcaaaaaacaatacagtgactcctggaggcaaaccaaacaaaaccagagtgatctggggaaaagtaactcgggcccatggaaacagtggcatggttcgtgccaaattccgaagcaaccttcctgcaaaggccattggacacagaatccgtgtgatgctgtacccatcccggatttaaactaatggagagta

SEQ ID NO: 2079 - DNA, 1585 bp, Rattus norvegicus
  Genbank Accession No. NM_021578
accgcctcccgcaaagacttcaccccaaagctggggcgcaccccttgcacgccaccctccccccagcctgcttcttgagtcccccgcatcccaggaccctctctcctctgggaggccgatctccctcggacctgctggcaatagcttcctatttaagaacaccccacttttgggtcccagagagcgctcatctcgatttttatcccggtggcatactgagacactctggtgtcagagcgtcaccgcgactcctgctgctttctccctcaacctcaaattattcaggactatcacctacctttccttgggagaccccaccccaccccacaagccctgcaggggcggggcctccgcatcccacctttgcccggggttcgcgctctccgaagttccgtggggcgccgcctcccccatgccgccctcggggctgcggctgctgccgcttctgctcccactcccgtggcttctagtgctgacgcccgggaggccagccgcgggactctccacctgcaagaccatcgacatggagctggtgaaacggaagcgcatcgaagccatccgtggccagatcctgtccaaactaaggctcgccagtcccccgagccagggggaggtaccgccgggcccgctgcccgaggcggtgctcgctttgtacaacagcacccgcgaccgggtggcaggcgagagcgctgacccggagcccgagcccgaggcggactactacgccaaagaagtcacccgcgtgctaatggtggaccgcaacaacgcaatctatgacaaaaccaaagacatcacacacagtatatatatgttcttcaatacgtcagacattcgggaagcagtgccagaacccccattgctgtcccgtgcagagctgcgcctgcagagattcaagtcaactgtggagcaacacgtagaactctaccagaaatatagcaacaattcctggcgttaccttggtaaccggctgctgacccccactgatacgcctgagtggctgtcttttgacgtcactggagttgtccggcagtggctgaaccaaggagacggaatacagggctttcgcttcagtgctcactgctcttgtgacagcaaagataatgtactccacgtggaaatcaatgggatcagtcccaaacgtcgaggtgacctgggcaccatccatgacatgaaccgacccttcctgctcctcatggccacccccctggaaagggctcaacacctgcacagctccaggcaccggagagccctggataccaactactgcttcagctccacagagaagaactgctgtgtacggcagctgtacattgactttaggaaggacctgggttggaagtggatccacgagcccaagggctaccatgccaacttctgtctggggccctgcccctacatttggagcctggacacacagtacagcaaggtccttgccctctacaaccaacacaacccgggtgcttccgcatcaccgtgctgcgtgccgcaggctttggagccactgcccatcgtctactacgtgggtcgcaagcccaaggtggagcagttgtccaacatgatcgtgcgctcctgcaagtgcagctga

SEQ ID NO: 2080 - DNA, 4831 bp, Rattus norvegicus
  Genbank Accession No. NM_021584
agcccgctccccgagcagccttagccatccctaactaatccaactgcttcccagtctgcgggtgctgggctcggtgctgagaagaggctctggctcttggctattgtcaggtcaaacactaagactgtgtccatgttagaactcatagaagttaatggaacccctggcagtcagctctccactccgcgctccggcaagtcaccaagtccatcgcccaccagcccaggaagcctgcggaagcagagggacctgtaccgccctctctcgtcggatgatttggactcagtaggagactcagtgtaaaagacacagtggagcgatgtgtatggtttgtgatgggatcaaggtttcccatttcctaagcaagcatctaacagcaaaatacacaaaagagttttgcataagcaattaaattatacaaaagcaagagtgcagacattttctactcggcggtattctttgaaagaaaaaaaaacttttttaaagcatctcctccatttgatgtaaccgaggagagtttgaatacaatatttgttcatcactgaggattttatgactaaggtctggttccagataaatttcatatatgactccaatattaagtacaagaatcaccctaacgatccagcattatggagtcaccatttctataaatgagcctgctttttaatcagtaagtagatatataaatacaatttttctgtacttagtatcttttacctttttagtttaaatttttttaaaaaaatcagacagctaattagttatttcattgcaaaataacataaaagaatctcttcaggattttttatttgagtgaatacgtctgaaggggagtggaggaactccgtaagagacgtctcccagagaccaacattaggcagcgagaacgtttctggttttttttttttttttttttttgtttttgttttttgccacatggattttcttttcccagatttttataaaaatagtttcaactacatggaaacatgaataacttggcattattattaattttataatggttccctacagcaacaacagtatatatatctttttcaagtgtgtaaagttttttgacctaaaacaaatgggacttgtactgtttttcaaaaaataaactcagtttgagaattggaattcttctacacagagcttgtacgttgggcctccaggtagctaaactccattctgatcatcctgcatcccgttgtttgggatatcttcacatgcaaaactccttttgtgtcaaaccgagtgtgtctatgattataacccactgttaaaattaacctactaattcttctcctttagtcctctactttcaaaagcgtgagtcagctttgcttaaatgtaaaacagttattttttaaatctagatgttagaaatcaatgtgtacggtgtattgtatttagaccatacccgtgaccgtttctttttactagctcaaacactaacaatttaagacttacaaagcatgggttttatattcgccaggcttgacatatctcagtagggtgacagatttaaaatgtatggtgccatttggagccttttacttgagatttctttcaaatttcacttgaaaacattttgaaaatgcctgattcaagatggagaggagttgccttgtcatacggtctcaaatgttattgatttatttctctcagtagactgttcgactagcaatttttcccatctggtttatcgttacctgtgctagcatctcacttgacaagtgaataaaatattccaactgaaaaaagaaaaataagacctccaggcaacctaccagcatttgaaaagttagccgagtgataattagtgcctcattaccctgcctgttagagaggagagggcacttctttggcgtgttatttgagaactgcagactgatccctccatcttgaaagcacagagaatgatcatacctgttccagacttcggattttaaaactgtttccaatagacacgaacagagactcctgctgagatgaaagggccgctttgtctttagctgaaacagtaaacatctgggaggatgctgtgctgcctgttggagtgttacgtctttgtaagatgcattgcttaatatagtccaacccgtaaaagattagtacagatttgactaacctgtcaaaaaatgcaatgaaagcagtgggtcagatggtccagaacaaaacataaattccagtaatttcaactcccctatgaagtcaatcttatggacgactactgctaggagaaacctaataaatgttatctgctataaaaatcgtggctttgtttagacacagcatagagtagacttggactaattgccagtaggtattgtggccaactttccattcaagcagttccagagagatgcaatcccatggcatttcatcctggaacatacgatttttattaaaggattgttcaagggccatatatctcatttacttttgaaactaaagtccctctgagattgaaacaacacaccctgagatctctttctatgcacggaataattctattatccaaaagcagagtttttgaacatccaagcagcccaccaggtcattagtaaagacccaatgggcaattagcagtcactcaagacgtggctgcttttagaatccttctaacatcattagtcgctgaactctaaaaatgaccttctgaggagagagctccagccaacaaaagccacatgcttttctctcactgataaagcctctgctgtgttgacctttcaggcctttgcatgtatggttacatttttttagacatacctagaaagaaagatgctataaagagtcccctgctttcagcattttatgagctaaaaccctagtgatgcacaaaatgtgttgctctgcgtgaactccgaagccatgtgggaaagtcattgtcatttcagcagaaggtctgtactcttgtaggtttctaaaccggaagtttgtgctccacctatatgtacgcatgcctgcaatgcacacatgaggtcaccttaacatgtcaagatctgatcccgttgtctgccaaccccagagcagctctgacacctatgctcccctgccaagcagcgagggcactcgccctccccttccttgcagccgcaccgagctgtacttttgtttccatttaaaagaactgaattccaaaagcctcgttttaaaaaagcaattgggaatgaaaatacataagaataatcctaaaagataaatccatatatttaacctgttgaactactaggttttttttttcttttcctggtggccatatatctatacaggtgtgtaggtgtgcctacataaatatctgtgtttgtatatagaacatgaagaataaaggatgatatttgtgatatggtcttataagttactggctcctgtagaattaactgtgaagctttatgtgataaagttgtgacgtatgtattagttggcacatgtttaagctcaaaacaagttggctaaattatcatgaagcagtaccaactgttcacgggtacgaatttatccaagaccgattggaatccagacaaacaaaaaaattgaagtccaagcaaatccaatcttacagtgattgataaatgtaaatactcattgatgttttcactgtaaattcttgatgctcagccagtaatctgacagaatgcagtgacactttcctgttgtgtgtgtactgatgactacagcgattatcaatgggaaattcaccaaacaaactgatttctagacttgtggacagttgagtgttgtgctgaaataaaagtagaaaaggtcaaagtaaattcggtttgaagccttgttatgaagccagacaacatgtaaggccatgctgtgtgtcctttttataaactgttttggagacacttgctgtgtgtgtgcatgtgtgtctacatgagtgtatacacacttgaaaatgcttattgactcaagttcactgtctgtatacatctgtgcctatctgcattggtctggccagcgcctctaactgtgcatggtagtgacagccctgtgtgattggatgaacccacagaaaaatagtgtggaaatcagagctgcgtcaaactcattataacaattgcctgatatagcatattaaattgtcagctgaaaaacgtttgtaatgttgtgcctgtaacatgtgtagggaaaactggaaaatctgaggccctcactataattttaagggtgcatgacatgtggtgtctttaaagatgtatcttattgtaataaaaggtgatggataaattctgaggtagcgtaagtgaagcatgaaacgctaggtgtttgtattatatatggccacacaatatttttgaaggcagggtagtaaatgtttgaaggttaataggcaaagaatatggaagttaattttactgtgatgtgtttttgaggtgtttttacacattgccagacaaggaacttagttcctgtttcccccctgtggactctttgaaacactatgaatgttacaaagttggattttctttataaaggtcgcaaaccatttgcagttggagttgcttggatgtatagtctcctctttggggaaaaaaaccactttggtattaaaatggtttaagcactaatacattgggaaatacgtcgtctgaggccatctgcagacatctgtagagatgagaactaatgaaatgtgttactgaactacccagttttgatagcttccatgcctctctgctgtagtctcctcgaaaatgctgtaccttgtgtttcacatgcaaccatgttactctctcccgaacttacctttgtgacacttagcagcttagccaaaccacgtaataaacaggaagaactgcaaaaaaaaaaa

SEQ ID NO: 2081 - DNA, 1002 bp, Rattus norvegicus
  Genbank Accession No. NM_021654
atgggtgactggggcttcctggagaagctgctagaccaggtccaggagcactcgaccgtggtgggcaagatctggttaacggtgctcttcatcttccgaatcctcatcctgggcctggctggtgagtcggtgtggggcgacgagcagtctgatttcgagtgtaacacagcccagccaggctgcaccaatgtgtgctatgaccaggctttccccatctcccacatccgatactgggtgctgcagttcctcttcgtgagcacacccaccctgatctacctgggccacgtcatttacctgtctcggcgggaagaacggttgcggcagaaagagggagagcttcgggcactgccatccaaggaccctcatgtagagcgggcactagcagccatagaacatcagatggccaagatctcggtggcagaggacggtcgtcttcgaattcgaggggcgctcatgggtacctacgtgatcagtgtgctgtgtaagagtgtgctggaggcaggcttcctctatggccagtggcgtctctacggctggaccatggagccggtgtttgtgtgccagcgtgcgccctgcccccacgtcgtggactgctacgtctctcgacccaccgagaagaccatcttcatcattttcatgttggtggtaggggtcatctccttggtgctcaacctactggagctggtgcacctgttgtgccgctgtgtcagccgggagataaaggcacggagggaccatgacacccgcccggctcagggcagtgcctcagacccttaccctgaacaggttttcttctacctccccatgggcgagggaccctcgtccccaccgtgtcccacctacaatgggctctcatccactgagcaaaactgggccaacttgaccaccgaggagagactgacctctaccagacctcccccatttgtaaatgcagccccccagggtggccagaagtcctctagccgccccaacagctctgcatccaagaagcagtatgtatag

SEQ ID NO: 2082 - DNA, 1265 bp, Rattus norvegicus
  Genbank Accession No. NM_021680
cgtcgccctcagccgggcgccccttgccctgtgcccagaccggcccgccccgggacccgccctgccggacccgcttggccgcccgggaagatgcggctgctcccggaatggctcctcttgctctttggtccttggctccttaggaaggttatcagtggccagatcgtggaatccgggaggccacagtacctggacctgcgtcccgccatggccggagggggcgcccgcggccagcagctcccggtgcccgcttcttccgagggcctgaaccccgtgcgctcctggagctgggcttggccagctaaccacaccggggcgctggccaggccgggggcagccggtggcccgcccgtgccgcgcaccaagagaaagccatccattaaagcggcccgcgccaagaagattttcggctggggggacttttactttcgtgtacataccctcaagttctcgctgctggtgaccggcaagattgtggaccatgtgaacggtaccttcagtgtgtacttccgtcacaattcgtccagcctgggtaacctaagtgtcagtatcgtgccgccttccaagcgtgtggagttcgggggcgtctggctgcctgggcctgccccccaccctctacagtctacgctggcattagaaggggtgcttcccggactggggccccctctggggatggcggggcaggggctggggggtaaccttgggggtgcacttgccggcccactcggaggcgcgctgggagttcctggggccaaagagtcgcgcgcttttaattgccacgtagaatatgagaagacaaaccgcgctcgcaagcaccgcccgtgcctgtacgacccgtcgcaggtgtgcttcaccgagcacacgcagagtcaggccgcttggctctgcgccaagcccttcaaagtcatctgtatcttcgtctccttcctcagttttgactacaaactggtgcagaaggtgtgcccagactataacttccagagtgagcacccctactttggataacgcccccgtcctgggcccagagtttcccaccagatctcagtctcactaggtgggaccctccctgtataccccatgctcctgtgactgcccccacgtcttccactatgggtgaggtggagaacaacagccttcccccgggactatcagccagtgtggccctccatttccttgtggtactgagtgtccctaagactcaaatgtcttcgtggcaggaggagagctcctggctagactcctgcacctgaacatgactggttgtc

SEQ ID NO: 2083 - DNA, 2691 bp, Rattus norvegicus
  Genbank Accession No. NM_021686
atggctctgataatggaaccagtgagcaaatggtctccgagtcaagtagtggactggatgaaaggtctcgatgactgcttacagcagtatattaagaactttgagagggagaagatcagtggagaccagctgctacgcattacacatcaggagctagaagatctgggagtcagccgtattggccatcaggagctgatcttggaggcagtcgaccttctgtgtgcactgaattatggcttagaaacagaaaatctaaaaaccctttctcacaagttgaatgcgtctgccaaaaatctacagaacttcataacaggaaggaggaggagcggccattatgatgggaggaccagccgaaaattaccaaatgactttttgacctcagttgtggatctgattggagcagccaagagtcttcttgcttggttggacaggtcaccatttgctgctgtgacagactattcagtcacaagaaataatgtcatacaactctgcttggagttaacaacaattgtgcaacaggattgcactgtctatgaaactgaaaataaaattcttcatgtgtgtaaaactctttctggggtctgtgaccacatcatatccctgtcgtcagatcctctggtttcacagtctgctcaccttgaagtgattcagctggcaaatatcaaaccaagtgaagggctgggtatgtatattaaatccacatatgatgggctccatgtaattacgggaaccacagaaaattcacctgcagatcggtgcaagaaaatccacgctggggatgaagtgattcaagtcaatcatcagactgtggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcagcctcttatacctagaagtcccacaagcagcgttgccacgccttccagcaccatcagtacacccaccaaaagagacagttctgctctccaggatctctacatcccccctcctcctgcagaaccatacattcccagggacgaaaaaggaaaccttccttgtgaagatctcagaggacatatggtgggcaagccagttcataagggatctgaatcccccaattcatttctggaccaggaatatcgaaagaggtttaacattgttgaagaagacactgtcttatattgctatgaatatgaaaaaggacgatcaagtagtcaaggaagacgagaaagcacaccaacctatggcaagctacgacctatatctatgccagtcgaatataattgggtgggggactatgaagatccaaataagatgaagagagatagtagaagagaaaactctctacttcgatacatgagcaatgaaaaaattgctcaagaagaatacatgtttcagagaaacagcaaaaaggacacagggaagaagtcaaaaaagaagggtgataagagtactagcccaactcactactccttgctgcctagtttgcaaatggatgcattgagacaagacatcatgggcacaccagtgccagaaaccacactgtaccatacatttcagcagtcctctctgcagcacaaatcaaagaagaaaaacaaaggagctatagcaggcaagagcaaaagaagaatttcttgcaaggatcttggccgtggtgactgtgaaggatggctttggaaaaagaaagatgcaaagagctatttttcacagaaatggaagaagtactggtttgtcctaaaggatgcatccttgtactggtatattaatgaagaggatgaaaaagcagagggattcatcagtctgcctgaatttaaaatcgatagagccagtgaatgccgcaagaaatatgcattcaaggcctgccatcctaaaatcaaaagcttttatttcgctgctgagcatctcgatgacatgaacaggtggcttaatagaattaacatgctgactgcaggatatgccgaaagagagaggattaaacaagaacaagattactggagtgagagtgacaaagaagaagcagatactccatcaacaccaaaacaagacagccctccacccccatatgacacatacccacggcctccctctatgagttgtgccagtccttatgtggaagcaaaacacagccggctttcctccacagagacctctcagtctcagtcttcacatgaggaatttcgacaggaagttactgggagcagtgctgtgtcccccattcgcaagacagccagtcagcgccgctcctggcaggatttaatcgagacgccactgacaagttcaggcttacactatcttcagactctgcctctggaagattctgtcttctctgactcggcagccatctcccctgagcacaggcggcagtccactcttccaactcagaagtgccacctccaggatcattatggcccataccctttagctgagagcgagaggatgcaagtgttgaatggcaatgggggcaagcctcgaagttttactctgcctcgagatagcgggttcaaccattgctgtctgaacgcaccagttagtgcctgcgatccacaagatgacatacagccaccagaggtggaggaagaagaggaggaggaggaagaggaggcagcaggagaaaacataggcgagaaaagctaa

SEQ ID NO: 2084 - DNA, 3373 bp, Rattus norvegicus
  Genbank Accession No. NM_021690
cgctaagcctggggtggtggtaggaaggtccagctcctccggccgatggctgtccactttcctccccccatcacaggtcagctggccaggtgagaaccactggcaggtgggcccagctgtggtggagagtccagctgtgggggcaccgcaggtgcgaggtctcccggacgtggttccggagggcacgctgctcaatatggtgctgaagagaatgcaccgtccccggtgctgctcttaccagctagtgttcgagcaccggcgcccaagctgcatccagggacttcgctggacgccacttaccaacagtgagggctccctggacttcagagtgagcctggagcaggccaccacagagcatgtgcacaaggccgggaagctcctgtaccgtcatctcttggcaacgtaccctaccctcatccgagacagaaaataccatctgcgactacatcggcagtgctgctctggccgggagctagtggatgggatcttggctctgggtcttggggtccactcacggagccaagctgtgggcatctgccaggtgttgctggatgagggtgccctttgccatgtaaaacatgactggaccttccaggaccgagacgcccaattctacagattccctggaccggagccccagcctgcaggaactcatgacgtggaagaggagcttgttgaggcaatggccctactctcccagcgagggcctgatgccctactcactgttgcactccggaagtccccgggtcagcgtacagatgaagagctggacctcatcttcgaggagctcgtacatatcaaggcggtggctcacctttctaactcggtgaaacgggaactagctgctgttctgctctttgaaccacacagcaaggcaggaactgtgttgttcagccagggggacaagggtacctcatggtacattatctggaagggatctgtcaatgtggtgacccgtggcaaggggctggtgaccacgttgcacgagggagatgactttggacagctggctctggtgaacgacgcacctcgagcagccaccatcatccttcgagaaaataactgtcactttctgcgtgtggacaagcaggacttcaaccgcatcatcaaggatgtggaagcaaaaaccatgagactggaagaacacggcaaagtggtgttagttttggagagaacctctcagggtgctggcccttcccgccctccgaccccaggcaggaaccgatatacggtaatgtctggcaccccagagaaaatcctagaactcctgttggaggctatgagaccggattccagtgctcatgacccaacagagacattcctcagtgacttcctgctgacgcacagtgtcttcatgccctgcacacagctctttgccgccctcctgcaccacttccacgtggagccatcagagcctgccgggggcagcgagcaggaacgcagcacctacatctgcaacaagaggcagcagattctgcgtctggtcagccggtgggtggccctctacagccccatgctccgctcagatcccgtggccaccagcttcctccagaaactctcagacctggtgagcagagatacccgacttagcaacttgctgagggaacagtatccggagagacggcgacaccacaggttggagaatggctgtgggaatgtatctcctcagaccaaggcccggaatgcacctgtttggtttcctaaccatgaggaacccctcccaagcagcgctggggccatccgagtcggggacaaagtcccctatgatatctgcagacccgaccactcggtgctgaccctgcacctgccggtgacagcctccgtgagggaagtgatggcagctttggcccatgaggaccactggaccaaggggcaggtgctggtaaaggtcaattctgccggtgatgtcgttggcttgcagccagatgcccgcggtgtggccacatccctggggctcaatgagcggatctttgttgtcgacccacaggaagtgcacgagctgaccccacaccctgagcagctggggcccactctgggttcttctgagatgctggacctagtgagtgccaaggacctggcaggccagctcacagagcatgactggaacctcttcaacaggatccaccaggtggagctgatccactatgtactgggcccccagcacctgcgggacgtcaccactgcaaacctggagcgcttcatgcgacgcttcaacgagctgcagtactgggtggccaccgaactctgtctctgcccggttcctggcccccgggctcagctactccggaagttcatcaagctggcagcccacctcaaggagcagaagaatctcaactctttctttgcggtcatgtttggcctcagcaactcggccatcagccgcctggcccacacctgggagcgtctgccccataaagtacggaagctgtactcggccctggaaaggttgctggacccttcctggaaccaccgagtgtaccgattggctctcaccaagctctctcctcctgtcatccctttcatgcccctgctactcaaagacatgaccttcattcatgaagggaaccacacactggtagaaaacctcatcaactttgagaagatgcgaatgatggccagagccgtgcggatgctccaccactgccgaagccacagcaccgcgcctctatcaccactcagaagccgggtttcccacatccacgaggacagccaggcatcaagaatctccacatgttccgagcagtccctgagcacccggagtccagccagcacctgggcttatgtccagcagctgaaggtcattgacaaccagcgggaactgtcccgcctctcccgggaactggaaccatgaggaaggactggctggagcaggcacttctctcagagaaagccagagcctgtgcaaccaagaggtccagaggccagccacagctgggcagggctctccacagagcggactcaaggccctggagtgggcagtgtcgaggcagctgtcctctgtgatgactgtcagctgtgaagatctttgatgttcacggccaaggaaaaggggccattgaggccccagaggggtaggagagctgggaggtgcaggactctggttcagtagagagccctcccaccgggctttctgcatgtctgtatgtctgtacatgcagctgtgtgtcctggatgccaggccctgtgcttgtattcacaggagccagcgagctcacatctgcatggtgtgtgtgtgtgtgtgtgtgtgtgtgtgtgtgtgtgtgtgtgagcactgggtggtgccttgcctgggagagggtggggagttctgctattctcaccacacatctgagataaacagctgggtgtgggcaaaaaaaaaaaaaaaaaaaaa

SEQ ID NO: 2085 - DNA, 1182 bp, Rattus norvegicus
  Genbank Accession No. NM_021740
gttcccgggtcgtgctccgcgctcactgcagccaccttcgccgcccaccgtctcctccaacgcggactccggcagctttctcgccagagtcctcgaaactcgactaattccttacgcgtacgaccagaccaccggcgtgccccaccatgtcagacgcggcagtggacaccagctccgagatcaccaccaaggacttgaaggagaagaaggaagttgtggaggaggcagagaatggaagagacgcacctgccaatgggaacgctcaaaatgaggaaaatggggagcaggaggctgacaatgaggtagatgaagaagaggaagaaggtggggaggaagaggaggaggaggaagaaggtgatggtgaggaagaagatggagatgaagatgaggaagctgaggctcctacgggcaagcgggtagctgaggatgatgaggatgatgatgttgagaccaagaagcagaagaagactgatgaggatgactagacagcaaaaggaaaagctaaccttacgcaccgtgacctattcaccctccacttcccgtctcagaatttaaacgtggtcaccttcgagtagagaagcaggcccccgcccgcccactgcgcgagtgccacccaccaatgacatgcgctcttcaccaccccaccaaaaccacaacatgaattggcaacatgggaggagaaaagaaccagaacttcccaggccctgctttttttcttaaaaatactttaaaaggaaaatttgtttgtattttttatttacattttatatttttgtacatattgttaggggtcagccatttttaatgataacgggtgaccaaaccagccttcagagcgttttctgtcctacttcagactttacttgtggtgtgaccatgttcattatactctcaaaggagaaaaaaaaccttgtaaaaaaaacaaaaacaacaacaaaaaaacaatcttattctgagcattccagtaactttttttgtgtatgtacctagctgtactataagtagttggtttgtatgagatggttaaaaaggccaaagataaaaagattttttttcctttttttttgtctatgaagttgctgtttatttttttggcctgtttgatgtatgtgtgaaacaatgtccaacaataaaccggaattttattttgctgagttgttccaaaaaaaaaaaaaggaatcc

SEQ ID NO: 2086 - DNA, 1591 bp, Rattus norvegicus
  Genbank Accession No. NM_021744
ggaaagaaactgaagcctttctcggagcctgtctgggctgctcccactctcagaatctaccgaccatgaagcttatgctcggcttgttgctgttgcctttgacactggtgcatgcctctcccgccacaccagaaccctgtgagctggaccaggacgaggaaagtgtccgctgctactgcaacttctcagatccgcagcccaattggtccagcgcttttctatgcgcgggggcggaagacgtggagttctacggcggcggtcgcagcctggagtaccttctaaagcgtgtggacacggaagcaaatctggggcagtacactgatattatcaggtctctgcccttgaagaggcttactgtgcggtccgcgcgggttcctactcagattctattcggaaccctgcgtgtgctcggatattctggcctccgggaactgactcttgaaaacctcgaggtaaccggcaccgcgctttcgccgcttctggatgccaccggacccgatctcaacaccttgagcctccgcaacgtgtcgtgggcaacaacggatacctggctcgcagaactgcagcagtggctaaagcctggactcaaggtactaagtattgcccaagcacactcactcaacttttcttgcaaacaggtcggcgtcttccctgcccttgccaccttagatctgtctgacaaccctgagttgggcgagaaaggactgatctcggccctctgtccgcacaaattcccgaccctccaagttttagcgctgcgcaacgcggggatggagacgaccagcggcgtgtgctctgcgctggccgcagcaagagtgccactgcaggcactggatctcagtcacaattcactgcgggatactgctggcactccgagctgtgactggcccagtcagctaaactcgctcaatctatctttcactgggctggagcacgtacctaaagggctgccagccaagcttagcgtgcttgatctcagttacaacaggctggataggaaacctaggccagaggagctgcctgaagtggggagcctgtcacttacaggaaatccctttttgcactctgaatcccagtcggaggcgtataactctggcgtagtcatagccacagctctttcacccggatcagcgggcttgtcaggaactttggctttgctcctaggacatcgcctctttgtttaaggaacgtttgcatcttcctggtttctgagggtcctggtcaacaaatcctctgctttaaatttattaaaatcttaatccacaatgtaaggaaggacaatcaagatggctcaatgggtaaaagccaccaagcttgactcctgattttgatcctcgggatccacaccaaaggaaagaactctctcctgaaagttgtccatcggtgctcacaaataaatatatttttttttccggagctgaggaccgaacccagggccttgcgctcactaggcaagcgctctaccactgagctaaatccccaaccccacaaataaatatttttaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2087 - DNA, 1980 bp, Rattus norvegicus
  Genbank Accession No. NM_021754
ggcacgagggaacgtctaggcaacgtggtctccccgcccgcgggtaggcaaaggcgtttgcgcttcccagcgtctgaggcctagggagccttcagtagccgaaagttagtcttttgcagtggagtaagggctcgcggttagccgcgtagcgcccggatctggcctcaccatgttggtcctatttgaaacgtccgttggctacgccatctttaaggttctgaatgagaagaaacttcaagaggttgatagtttgtggaaagaatttgaaactccagagaaagcaaataaaatagtaaagctaaaacattttgagaaatttcaggatacagcagaagcattagcagcgttcacagctctgatggaaggcaagatcaataagcagctgaaaaaagttttgaagaaaatagtcaaagaagcccatgaacctctggctgtagctgatgctaagctaggaggggtcataaaggaaaaattgaatctcagctgtatccatagtcctgttgttaatgaacttatgagaggaatacgatcacaaatggatggcttgattcctggggtagaaccacgggagatggcagccatgtgtcttggactagcccacagcctatctcgatacagattgaaattcagtgctgataaagtagacacaatgatcgttcaggcaatttccttgttagatgacttggataaagaactaaacaactacattatgcggtgtagggaatggtatggctggcattttcctgagttagggaaaattatttcagataatttgacatactgcaagtgtttacagaaagttggagacaggaagaactatgcatctgccactctttctgaattcctgtcagaggaagtagaagctgaagtgaaagcagctgcagagatctctatgggaacagaggtttctgaagaagatatttgcaacattctacatctgtgtactcaggtcattgaaatttctgaatatagaactcagctgtatgaatatctgcaaaaccgaatgatggccattgcacccaatgttacagtcatggttggggagttggttggagcgcggcttattgctcatgcaggttctcttttgaatttggccaagcatgcagcttctacagttcagattctgggagcagaaaaggcacttttcagggccctcaaatctagacgagacacacctaaatatgggcttatttatcatgcttctcttgtaggccagacgagtcccaaacacaaaggaaagatttcacgaatgctggcggccaaaactgtgttggctatcagatacgacgcctttggtgaagattccagctctgcaatgggagctgagaacagagccaaattagaggccagattgaggattttggaggacagagggataagaaaaataagtggaacgggaaaggcattagcaaaagcagaaaagtatgaacacaaaagtgaagtgaagacttacgatccctctggtgactccacacttccaacttgttctaaaaaacgcaaaatagaagaggttgataaagaggatgaaattactgaaaagaaagcaaaaaaagccaagattaaaattaaagctgaagtagaggaggagatggaggaggcggaggaagaacaggtagtagaagaggagccgactgtaaagaagaaaaagaagaaggataaaaagaaacacataaaggaagagccactttccgaggaggagccatgcaccagcacagcagttcctagtccagagaaaaagaagaaaaagaaaaaaaagaaagatgctgaagactaatgtaaaggaaccgtaatcctgtcacctgaacacatcatgcttaagattcagttgggagcatatcagacgctctaacataatcaagggaggttgattagctttagcttttcaaacctttttgtgtcttgacatcaactgttaaccttagagtctttgatacacaaataaaaatattttctttgtattataaaaaaaaaaaaaaaaaa

SEQ ID NO: 2088 - DNA, 1885 bp, Rattus norvegicus
  Genbank Accession No. NM_021766
gcaaaattaatttattggccactgttcgcttagagggcggaggaagccgactgtttcggtctctgcataacaggcccaaacctttgctccagagatcatggctgccgaggatgtggtggcgactggcgccgaccccagcgagctggagggcggcgggctgcttcaagagattttcacgtcgcctctcaacctgctgctccttggcctctgcatcttcctgctctacaagatcgttcgcggggaccagcccggtgccagtggggacaacgacgacgacgagccgcccccgctgcctcgcctcaagccgcgtgacttcacccctgccgaactaaggcgatacgatggagtccaggacccgcgcattcttatggccatcaacggcaaggtgttcgacgtgaccaaaggccgcaagttctatgggccggagggaccatacggggtctttgctggaagagatgcatccaggggccttgccacattttgcctggacaaagaagcactgaaggatgagtatgatgacctttctgacctcactcctgcccagcaggagaccctgaatgactgggactctcagttcagttcaccttcaagtaccatcacgtggggaaaactgcttgaaggagcggaggagccgattgtgtactcggatgatgaagaacaaaagatgaggctgctcggaagagtgactgaagcagtcagtggagcatatctatttttgtattttgcaaaatcatttgtaacattccagtctgtctttacaacatggtgatttcaatatttagagaagttttgaacttgtaagttttttaagtaacatcactagtgacaccgataaaatcaactcgtcttagaatgcatgatgtgtttgtacgtcacaaatccagaaagtgaactttagttctctagatccaaatggtaaagctgtttctcttctatctgtagttaaaactgaattacaattttattttcctgagagggaaaacttgggttatttccacaaactggccttttttcaagtgcacacacacacagtggccccaaatggtcaatgtactaagaatgaagagagaaggtcttagccatgctatagtctgaaaacaagcccattttacccaacagacttaactgcatgatttttgttttatctacctctaaagcaaaactgcagtgttccaaagtctgtggtattgattcaaaacagaagtccagtaacaaaatgaaaactcaataatgggtttagttggggcaaacacattgcctgtgttcatggactgatttatcatccctgtccccacgtggacactcccacacacagtaactctcacacacctggtaattggcagttggaactacaacagaaatctgaaaattcaaggtagaactttgcaaaagaaaaatctgttgcttgtagcagggcaatggttatgtggttattggccaaatgtaaaatttgagagcaatatacaggacaggaacaggtgtgcgcttttcaaaagcttccactgacatctctgaagaatgagaaaacactacatggcactagctgggtgattttgaaaggaaaatacattcctaaggtaacagttaatcctctgttgttacaaaactcgtagtcgcttcaaaaatagtagtcaggtgtctaggtcttggataatactcttggttaatactaaacctagcttaagtagactctgcagttgtatacatttgttaaaagtattatctgaacaactagtgaggtttcagactcttgtaattgtagttaaatagtcattgtattttcttgtgagctgtgtttaatggttttacctcaaatcagaaaaaaatgaagtgcttgggtcagttaataaaacggttttgcccagtaaaaaaaaaaaaaaaaaaa

SEQ ID NO: 2089 - DNA, 2573 bp, Rattus norvegicus
  Genbank Accession No. NM_021835
gacgactggtctgcgccgccggagaacctctgtcgctggggctggtccgcgggctccgaggaaccgctgcttcctgagagcgctccgtgagtgaccgcgacttttcaaagctccggatcgcgcgggaccaaccaacgtgagtgcaagcggtgtcttaaccctgcgctccctggagcgaactggggaggagggcgcaggggggagcactgcggtctggagcgcacgctcctaaacaaactttgttactgaagcggggacgcgcgggtatcccccgcttcccggcgcgctgttgcggccccgaaacttctgcgcacagcccaggctaaccccgcgtgaagtgaccgactgttctatgactgcaaagatggaaacgaccttctacgacgatgccctcaacgcctcgttcctccagtccgagagtggcgcctacggctacagtaaccctaagattctgaagcagagcatgaccttgaacctggccgacccggtgggcaatctgaagccgcacctccgagccaagaactcggaccttctcacgtcgcccgacgtcgggctgctcaagctggcgtcgccggagctggagcgcctgatcatccagtccagcaatgggcacatcaccactacaccgacccccactcagttcttgtgccccaagaacgtgaccgacgagcaggagggcttcgccgaaggcttcgtgcgcgccctagctgaactgcatagccagaatacgctgcccagtgtcacctccgcggcacaacctgtcagtggggcgggcatggtcgctcccgctgtggcctcagtagctggcgctggcggcggcggcggctacagcgccagcctgcacagtgagcctccggtctacgccaacctcagcaacttcaacccgggtgcgctgagcagcggcggtggggcgccctcctatggcgcgaccgggctggcctttccatcgcagccccagcagcagcagcagccgcctcagccgccgcaccacttgccccaacagatcccggtgcagcacccgcggctgcaggcgctgaaggaagagccgcagacggtgccggagatgccgggagagacgccgcccttgtcccccatcgacatggagtctcaggagcggatcaaggcggagaggaagcgcatgagaaaccgcatcgctgcctccaagtgccggaaaaggaagctggagcggatcgcccggctagaggaaaaagtgaaaaccttgaaagcgcaaaactccgagctggcgtccacggccaacatgctcagggaacaggtggcacagcttaaacagaaagtcatgaaccacgttaacagtgggtgccaactcatgctaacgcagcagttgcaaacgttttgaggacagactgtcagggctgaggggcagtggaagaaaaaaataacagagataaacttgagaacttgactggttgcgacagagaaaaaaaagtgtccgagtactgaagccaagggtacacaagatggactgggttgcgacctgacggcgcccccaatgtgctggagtgggaaggacgtggcgcgcctggctttggcgaggagccagagagcagcggcctgttcgcgacgctttgcgaacgggctgtgccgcgaccagaacgatggacttttcgttaacattgaccaagaactgcatggacctaacattcgatctcattcagtattaaggggggtgggtgggggcttacaaactgcaatagagactgtagattgcttctctagtgctccgtaagaacacaaagcagggagggctgggaaggggagggaggcttgtgagtaccaggctagattgcggatgaactcccctggcctgcctctctcaactgtgtatgtacatatatttttttttaatttgatgaaagctgattactgtctataataaacagcttcctgcctttgtaagttatttcatgtttgtttgtttgggtgtcctacccagtgtttgtaaataagagatttgaagcattctgagtttaccatttgtaataaagtatataatttttttatgttttgtttctgaaaatttccagaaaggatatttaagaaaacacaataaaccattgagaagtagcccccaacctctctgctgcattatcgatagataatgagagctaggtgaaatgacagctgagtgtctgtatgctggggtgagagcctgtagtccctcccgtctggttgtaggaatagacaccctgcatgctatcattgactcatactctctccccagcaacccacaagtccagactgttgaccagaagatggtgcagtgtttcttaaggctggaagaagagggtgttgcaaggggagagggacagcccactgggaaagcagatgcttgagttgagagccatatcaagtagcatgcgctgtgatcgtttataataataataaagacttcagcaattagatgtttatctcaaagcagggacccatggaaggttttacaaaaggtgtctccttccaacttggattctgacgactcctagaaaaagatgacctttgcttgtgcatatttataatagttcgtatcacaataaatgtattcaaataatggtttt

SEQ ID NO: 2090 - DNA, 1035 bp, Rattus norvegicus
  Genbank Accession No. NM_021836
atgtgcacgaaaatggaacaggctttctatcacgacgactcttacgcagcggcaggatacggtcggagccctggcagtctttctcttcacgactacaaactcctgaaacccaccttagcgctcaacctggcagatccttatcggggtctcaagggtcctggggcgcggggtccaggcccagagggcagtggggcaggcagctacttttcgggtcagggatcagacacaggcgcatctctgaagctagcctccacggaactggagcgcttgatcgtccccaacagcaacggcgtgatcacgacgacgcccacgcctccgggacagtacttttacccccgtgggggcggcagcggcggaggtacagggggcggcgtcaccgaggagcaggagggctttgcggacggttttgtcaaagccctggacgacctgcagaagatgaaccacgtgacgccccccaacgtgtctctgggcgccagcgggggtccccaggccgggccagggggcgtctatgctggtccggagccgcctccggtctacaccaacctcagcagttactccccagcctctgcaccctctggaggttccgggaccgccgtcgggactgggagctcatacccgacggccaccatcagctacctcccacatgcaccaccctttgcgggcggccacccggcacagctgggcttgagccgtggcgcttccgcctttaaagaggaaccgcagaccgtaccggaggcacgcagccgcgacgccacgccgcctgtgtcccccatcaacatggaagaccaggagcgcatcaaagtggagcgaaagcggctgcggaacaggctggcggccaccaaatgccggaagcggaagctggagcgcatcgcgcgcctggaggacaaggtgaagacactcaaggctgagaacgcggggctgtcaagtgctgccggcctcctacgggagcaagtggcgcagctcaagcagaaggtcatgacccacgtcagcaacggctgccagttgctgctaggggtcaagggacacgccttctga

SEQ ID NO: 2091 - DNA, 624 bp, Rattus norvegicus
  Genbank Accession No. NM_021867
atggcggaggtcgggggcgtctttgcctccttggactgggacctgcaaggcttctcctcctctctggggaacgtgcccttagctgactccccgggtttcctgaacgagcgcctgggccagatcgaggggaagctgcagcgcggctcgcccacagacttcgcccacctgaaggggatcctgcggcgccgccagctctactgccgcacgggcttccaccttgaaatcttccccaatggcacggtgcatggcacccgccacgaccacagccgcttcggaattctggaatttatcagcttggctgtggggctgatcagcatccggggagtagactctggcctatacctaggaatgaatgagcgaggagagctgtttggatcgaagaaactcacacgagaatgtgttttccgggaacagtttgaagaaaactggtacaacacctatgcatccaccttgtacaaacactcggactcggagagacagtattatgtggccctgaataaagacggctcaccccgggagggatacaggactaaacgacaccagaaattcactcactttttacccaggccagtagatccttctaagttgccctccatgtccagagacctcttccgctataggtaa

SEQ ID NO: 2092 - DNA, 1009 bp, Rattus norvegicus
  Genbank Accession No. NM_021989
gaattccggtagaaggcagcggaggagccgagccgggctgcgctcgctcgccgccccctagcctctttcttctccgccgggtgcactgccctgcgctgtcccctcgcctcttcgcccccttgacaaagaggacagaaagtttgcgcgggggagcgggccaggtgaggaggggcgtgccggcgccagcccgcgccccagcagccggacccaggcccctagcgcgcccgccatgggcgccgcggcccgcagcctccggctggcgctcggcctcctgctgctggccacgctgctgcgcccggccgacgcctgcagctgctccccggtgcacccgcaacaggcgttttgcaatgcagacgtagtgatcagggccaaagcagtgagcgagaaggaggtggattccgggaatgacatctatggcaaccccatcaagaggattcaatatgagatcaagcagataaagatgttcaaaggacctgacaaggacatcgaatttatctacacggccccctcctcagcagtgtgcggggtctcgctggacgttggaggaaagaaggaatatctaattgcagggaaggcggaaggagatggcaagatgcacattaccctctgtgactttattgtgccctgggacacgcttagcatcacccagaagaagagcctaaaccacaggtaccagatgggctgcgagtgcaagatcacacgctgccctatgatcccatgctacatctcctccccggatgagtgcctctggatggactgggtcacagagaagagcatcaatgggcaccaggccaagttctttgcctgcatcaagagaagtgatggttcttgcgcgtggtaccgcggggcggcacccccgaagcaggagtttcttgacatcgaggacccgtaagcaggctgacagagccccctgtggccaattgaaaagcctctgagggttcagactggtccagctttgacatcccttcctggaaacagcatgaataaaacatcaatcatcccggaattc

SEQ ID NO: 2093 - DNA, 3692 bp, Rattus norvegicus
  Genbank Accession No. NM_022179
gtcgtcttatttgggagctgagacttgaggaaggtgataacttctgaatccccccaggtagtcaataccattgtggaaacatggccgccattgagccttctggtctgcacccgggagaaagagactcaagctgcccccaggagggcattccaaggccctcaggtagcttagaactggcacaggaatacttgcaacaattcaaggtgaccatgacacagctgcagcagatccaagccagtcttctgtgttccatggagcaggcgctgaagggacaggacagtcccgctccttctgtccggatgttgcccacatacgtgaggtccacaccacatggcaccgagcaaggagacttcctggtgctggagctgggggccacaggagcctcactacgtgtgttgtgggtaacactgacgggcaccaaggaacacagcgtggagaccaggagccaggagtttgtgatccctcaagaggtgatcctaggtgctggccagcagctctttgactttgctgcccgctgcctctctgaattcctggatgcataccccgtggagaatcagggtctgaagcttgggtttaatttctcttttccttgtcaccagacaggcttggacaagagcaccctcatttcctggacaaaaggttttaggtgcagtggtgtggaaggccaggatgtggtccagttgctaagggatgccattcagaggcaggggacctacaatattgatgtggtagccatggtgaatgacacagtgggtaccatgatgggctgtgagctgggcaccaggccatgtgaagtcgggcttattgtagacactggtaccaatgcctgttatatggaggaagcgaggcacgtggcagctctggatgaggaccgcggccgtacctgtgtcagcatcgagtggggctccttctatgacgaagaggccctagggccagtactgaccaccttcgacgatgccctggaccacgagtccctggttcctggtgctcagaggtttgagaagatgattggtggcctttacttgggtgagctggtaaggctggtgctggtccacttgtcccagcatggggtcctctttggtggctgcgcctctcctgcgttgctgagtcaaaacagcatcctcctggaacatgtggccaaaatggaggaccctgccactgggatagcccacgtccacacagtcctgcagggcttgggtctgagccctcaggcctcagatgctgagctcgtgcagcgcgtgtgcatggctgtgtgcacgcgagctgcccagctctgtgcctctgccctggctgcagtcctatcccgcctccagcacagcagggagcagcagacactgcacgtggccgtggccactggagggcgagtgttcgaatggcaccccaggttcctctgcatcctaaaggagacggtaatgctcttggccccagagtgtgatgtctccttcatcccctctgtggatggtggtggccggggtgtggcaatggtgactgctgtggcagcccgcctggctacccacaggcgcatcctggaagagaccctggcaccatttcagctgagcttggagcagctgacagcggtgcaggcacaaatgcgggaagccatgatcagggggcttcaaggagagagctcctccctccgcatgctgcccacttacgtccgagcaacgcccgatggcagcgaacgaggtgacttcctggctttggacctagggggcaccaacttccgtgtcctgttggtacgcgtggccgagggcagtgttcagatcaccaaccaggtctactctattcctgagtatgtagcccagggctctggacagaagctctttgatcatattgtggactgcatcgtggacttccagaagaggcaaggccttagcggacagagcctacccctgggtttcaccttctcttttccttgcaagcagcttggcctggaccagggcatcctcctcaactggactaaggggttcaatgcatcaggctgcgagggccaagatgttgtgtatttattacgggaagccattaggcgcagacaggcagtggagctgaatgtggttgccattgtcaatgacacggtggggaccatgatgtcctgtggctatgatgatccctgttgtgagatgggcctcattgtcggaaccggtaccaacgcctgctatatggaagaactccggaatgtggcgagtgtgcccggggactcaggccacatgtgtatcaacatggagtggggtgcctttggggatgacggctcactgagcatgctcggcacctgctttgatgctagcgtggaccaggcatccatcaacccaggcaaacagaggtttgagaaaatgatcagcggaatgtacctgggggagatcgtccgccatatcctcctgcacttaaccagtcttggagttctcttccggggccagaagacgcaatgccttcagaccagggacatctttaagaccaagtttctctccgagattgagagcgacagcctggccctgcgtcaggtccgagccatcctggaggacctggggctgactctgacgtctgatgatgccttgatggtcctagaggtgtgccaggctgtgtcccgcagggccgcccaactctgcggggcaggtgtggctgcagtggtggaaaagatacgggagaaccggggcctgcaggagctgacagtgtctgtgggagtggatgggacgctctacaagctacatccccacttctccaggctggtgtcagtgacagttcggaagctagcccctcagtgcacagtcacctttttgcaatcggaggatgggtctgggaaaggggcagcgttggtcactcgtgtcgcttgccgcctgacccagatggcctgcgtttgaggaaaatctccaaagagcaattgggatctccctggactaaggattcagcccacacggaccctctggcgggcccagccacccacaactcccaaagaaacccacgggtggtgccctcataactgtccgcccacacccaatggctttctgagagaagcaccactctggttagcaaggaattccccgaagatggcggaggggcaggttctagtattggatggccggggccatcttctgggccgcctggccgattgtggccaactgctgggcaggtagccgaaaggtggtggttgtacgctgtgagggcatcaacatttctggaaatttctacagaaacaagttaaagtatctggccttctccgaaagcggatgaacaccaacccgtctcgaggcccctaccacttccgagccccaagccgcattttttggcgcactgtgcgaggcatgctgccgcacaagaccaaaagaggccaggctgccctggaacgcctcaaggtgttggatgggatccctccaccctatgacaagaaaaagcggatggtggtccctgctgccctcaaggttgtgcggctgaagctaccagaaagtttgcttacctggggcgtctggctcatgaggtcgggtggaagtaccaggcagtgacagctactctggaggagaaacggaaggaaaaggcaaagatccattaccggaagaagaagcagctcttgaggctaaggaaacaggcagaaaagaatgtggagaagaaaatctgcaagttcacagaggtcctcaagaccaatggactcttggtgtgaaccaataaagactgtttgtgcctcaaaaaaaaaaaaaaaaaaa

SEQ ID NO: 2094 - DNA, 6052 bp, Rattus norvegicus
  Genbank Accession No. NM_022183
aaatgaaactagggaagctctcctaaccgacgcacgtctgtggagaagcgtccaagtcgccggtcgcctagcgtttctcactgattttgtcgcttttaggattctcgagccccttcaggacggtcaccatggagttgtcaccgctgcagcctgtaaatgaaaatatgctactcaacaaaaagaagaatgaagatggcaagaaaagactgtccgttgaaagaatctatcagaaaaaaacccaactggaacatatactgctccgcccagatacctacatcggctctgtggagttagtgacccagcaaatgtgggtttacgatgaagatgttggtattaactacagggaagtcacttttgttcctggtttgtataaaatctttgatgaaattctagttaatgctgctgataacaaacaaagggacccaaaaatgtcttgcattagagtcacaatgatgcgaaataatttaattagtatatggaataatggaaagggaattcctgttgttgaacacaaagtggagaaaatgtatgtcccagctctcatatttggacagctcctgacctccagtaactacgatgatgatgagaagaaagtgacaggtggtcgaaatggctatggagctaaactgtgtaacatattcagcaccaaatttactgtggaaacagccagtagggaatacaagaaaatgttcaaacagacatggatggataacatggggagagctggtgacatggagctcaagccctttagcggagaggattacacgtgtattaccttccagcctgacttatctaagtttaaaatgcaaagcctggacaaagatattgtcgcactgatggtcagaagagcatacgatattgctggttccaccaaagatgtaaaagtctttcttaatggaaacaggctgccagtcaaagggttccgtagttacgtggatatgtatttgaaggataaggttgatgaaactgggaacgctctgaaggtggtgcatgaacaagtaaatccccggtgggaagtgtgcttaacaatgagcgagaaaggctttcagcagattagcttcgtcaacagcatcgctacttctaagggtggcagacatgtcgattatgtagccgatcagattgtgagtaaactcgttgatgtggtgaaaaagaagaacaagggaggtgttgcagtgaaggccgatcaggtgaagaatcacatgtggatttttggaaatgcggtaattgaaaacccaacctttgattctcaaacaaaagaaaacatgactttacaagccaagagctttggatcaacttgtcaattaagtgaaaaattcatcaaagctgcaattggttgtggtattgtcgaaagcatactaaactgggtgaagtttaaggcccaaatccaattaaacaagaagtgttcagctgtaaaacataacaggatcaagggaatccccaaacttgacgacgccaatgacgcagggagccgaaactctgctgaatgcacacttatcctgactgaaggggactcagccaaaactctggcagtctcaggacttggagtggttggaagagacaaatatggggtgttccctctcagaggaaaaatactcaatgtgcgagaagcttctcataaacagatcatggaaaatgctgaaattaacaatatcatcaagattgtggggcttcagtacaagaaaaactatgaggatgaagattcattgaaaactcttcgttatgggaagatcatgattatgacagatcaggaccaagatggttcccacatcaaaggcttgctgatcaattttatccatcacaattggccatctcttctgcgacatcgttttctagaagaatttatcactcctattgtaaaggtatctaaaaacaagcaagaaatagcattctacagtcttcccgagtttgaagaatggaagagtacaaatccaaatcacaaaaaatggaaagtcaagtactacaaaggtttgggcacgagcacatcaaaggaagctaaggagtattttgcaaatatgaaacgacatcgtattcagttcaaatactctggccctgaagacgatgctgcgatcagcctggcctttagtaaaaaacaggtcgatgatcgaaaggaatggttaactaatttcatggaagatagaagacagcggaagttacttggccttcctgaggattatttgtatggacaaaccactatgtacctgacctataatgatttcattaacaaggaacttatcctcttttcaaactctgataatgaaagatctatcccatctatggtagatggtttgaaaccaggtcagagaaaggttttgtttacttgtttcaaacggaatgacaagcgagaggtgaaagttgcccagttagctgggtcagtggcagaaatgtcctcttatcaccatggtgagatgtcgctgatgatgaccattatcaatttggctcagaattttgtgggtagcaataatttgaaccttctacagcctattggtcagtttggtaccaggctgcatggtggcaaggactcagccagccctaggtacatctttacaatgctcagccctttggctcggttgttatttccatcaaaagatgatcacacgttacggtttctgtatgacgacaaccagcgtgttgagcctgaatggtacatccctattatacccatggtgctgataaatggtgctgagggaattggtactgggtggtcctgcaaaatccccaactttgatgttcgtgaagtcgtaaataatatcaggcggctgttggatggagaagagcctctgcccatgctcccaagttataagaattacaaaggtactattgaagaactggcttcaaatcagtatgtgattaatggagaagtagctattctgaattccacaaccattgagatcactgagcttcccatcagaacatggacccagacatataaggaacaggttctagaacctatgttgaatggcaccgagaagacaccccctctaataacagactatagggaataccacacagataccactgtgaagtttgtcataaagatgactgaagaaaaattggcagaggcagagagagtgggactacacaaagtcttcaaactccagactagtctcacttgcaactctatggtactttttgaccatgttggttgtttaaagaaatatgacactgtgttggatattctaagagacttctttgagctcaggcttaaatattatggattaagaaaagaatggcttctaggaatgcttggtgcagaatcttctaaactgaataatcaagctcgctttatattagagaaaatagatggcaaaatagtcattgaaaataaacctaagaaagaattaattaaagttctgattcagagaggctatgactccgaccctgtgaaagcctggaaagaagctcagcagaaggtcccagaagaagaggaaaatgaagagaatgaagagagcgagagtgaaagcacgagccctgcagcggagtctggaccgaccttcaactaccttcttgatatgcccctgtggtatctaaccaaggagaagaaggacgagctgtgcaagcaaagggacgagaaggaacaagagctcaacacgttaaagaaaaagactccatcggatttgtggaaggaagacctggctgcttttgtggaagaactggaggttgttgaagccaaggaaaaacaggatgaacaagtaggacttcctggaaagggggtgaaagcgaaggggaagaaagcgcagatatctgaagtcctgccttctcctgtggggaaaagggtcatcccgcaggtgactatggagatgagagctgaggcagagaagaaaatcaggaggaaaattaagagcgagaatgttgagggcacccctgctgaggatggtgctgagccaggactccggcagagactagagaagaggcagaagagagagccaggtaccagggcaaagaagcaaactacattgccatttaagcctatcaaaaaagcccaaaagcaaaacccttggtctgattctgaatcagatatgagcagcaacgaaagcaattttgatgtccctccacgagagaaagagccaagaattgctgcaacaaaagccaaattcacggcggatttagactctgatgacgatttctcaggcttggatgagaaggatgaggatgaagatttcttcccattagatgatactccacctaagaccaaaatgcccccaaaaaatactaaaaaagcactgaagccacagaagagctccacatcagttgatcttgaaagtgatgggaaagacagtgtaccagcttctccaggcgcttctgctgctgacgtcccagctgagactgaaccctccaagccgtcctccaaacagacagtgggagtgaagaggacaataaccaaaggtcagtctttaacctccactgctggcaccaaaaagagagctgtaccaaaggagaccaagtcagattcagccttgaatgctcatgtctccaaaaagcctgctcctgccaaagccaagaacagtcgcaagaggatgccatcttcttctgacagctcggactctgagtttgagaaggcgatttctaaaggtgccacaagcaagaaactcaagggagaggagcgggatttccatgtggacttagatgacactgtggctcctcgagcaaaatccggacgagcaaggaagccgattaagtacctggaggagtcggatgacgacctcttctaaggggtgaggggatttcaggaatggttttactgagccacgttagttttaaagttcttccttaaccactctgaatttaattggcaggaagacttttttttaaataagaatatgcaagtgagcaggcccctgtggccttcacctttgttctcaacatactgtcagtagtggccgtctcgtgggcattgtcgtcttctctgattgtctgttttatgtctgttttctttggtctctgaaacctggcttgaatattttttggattccacataattatatgcttactcagcacagtagcatttatcaatttaaactaaagtggaaatggtttcaaaagcattcctgcctcctttcctatcccactaaatatgaggtaagacagcccttgttttcaattttataggtagaattccggccgggatcccccggcctgcctctgacggcggggactcagcttcggagagtcgggaggcatcaggtggcccgcagctctcgtcctctgcgtccttctcgcggtggctgaccgcgactccgaagaggtggctggccgctgcgcttggcggggtggggcgggatggcggcgtctgatggctggaggcggcctggccgggtactcttctacccgactctgctctacacagtgttcctggggagggtaggcagcccgaccaccgcgattggtaccaccgcatcgaccacacagtgctgctgggcgcagtgccgctgaggagcatgacgcgccggctggtactggacgagacgtgcgacggagtgatcactatgaacgaggagtacgagaccagattcctgtgcaacacctcgaaggaatggaagaatgtgggagttgagcagctacggctcagcacagtcgacatgactggagtccccaccttggccaacctccacagaggagtccagtttgctctcaagtaccagtccctgggccagtgtgtctacgtgcattgtaaggctggtcgatccagaagtgccacaatggtcgaggcctatctgattcaggtacacaactggagcccagaggaggctatagaagctatcgccaaaatccggtcacacatctccatcaggcccagccagttggaaattctcaaagagttccagaaggagattcgtgcaagggcagcaaataactaactactggtctcttgtgctgacatgagtatgaagtctgtggatgacaaagaacttggctctccgagatacagtaacatgttaaaggacaaagcgcttaagctaccaccactgcaaatgtgctgagtataatgtccctcctttgccttccttcctgaaataacacttggatggccacagagaaaaaaaaaaaaaaaaaa

SEQ ID NO: 2095 - DNA, 609 bp, Rattus norvegicus
  Genbank Accession No. NM_022196
atgaaggtcttggccgcagggattgtgcccctactgctcattctgcactggaaacacggggcagggagcccccttcccatcacccctgtaaatgccacctgcgccatacgccacccgtgtcacggcaacctcatgaaccagatcaagagtcaactggctcaactcaacggcagtgccaatgccctctttatttcctattacacagctcaaggggaaccatttcccaacaacgtggataagctatgtgcgccaaacatgacggatttcccacctttccatgccaatgggacagagaagaccaagttggtcgagctgtatcggatggtcacgtacctgggagcctccctgaccaacatcacctgggatcagaaaaacctcaaccccactgccgtgagcctccagatcaaactcaatgcgactacagacgtcatgagggggctccttagcagcgtgctttgccgtctgtgcaacaagtaccatgtgggccatgtggatgtgccctgtgtccccgacaactctagcaaagaagccttccaaaggaagaagttgggctgccagctcctggggacatacaagcaagtcataagtgtgttggcccaggccttctag

SEQ ID NO: 2096 - DNA, 2244 bp, Rattus norvegicus
  Genbank Accession No. NM_022198
atggacttccttgatgagcccttccctgatgtggggacctatgaagacttccacaccatagactggctgagggaaaagtcccgggacactgacagacatagaaagataaccagcaaaagtaaagagtctatttgggagttcatcaagagtctgctggacgcatggtcaggatgggtggtgatgctacttattggtctgctagcaggtaccctggctggagttatcgatctcgctgttgactggatgacagacctcaaggagggcgtctgtctgtctgcattctggtacagccatgagcaatgctgctggacctccaatgagaccacttttgaggacagggacaagtgtcccctgtggcagaagtggtcagagcttcttctgagccagtcagagggtgctagcgcttacattctgaattacttaatgtacattctatgggcattgctgtttgcatttctggctgtctccctggtacgtgtgtttgcaccatatgcctgtggctctggcatacctgagataaagactattttgagtggctttatcatcaggggctacttggggaaatggactcttctaatcaagactgtcactctcgtgctggttgtatcctctggcctgagtcttgggaaagaggggccactggtgcatgtggcatgttgctgtggcaacttctttagcagccttttctccaagtatagcaagaatgaaggcaagaggcgtgaggtgctttccgctgcagctgctgctggtgtctctgtggcctttggtgctcccataggaggtgtactcttcagtctagaggaggtcagttactactttcccttgaaaaccttgtggaggtcattttttgcagccctggtggctgccttcacactgcgctccatcaacccctttggaaatagccgcctggttctcttttatgtggagtatcatacaccttggtacatggctgaactcttccctttcatcctgcttggagtctttgggggtttgtggggaaccgtcttcacacgctgcaacattgcctggtgcaggaggcgtaaaaccaccaggctggggaagtatccagtgttggaggtcattgtggtgacagccatcactgccatcattgcttatcccaatccctacactcgccagagcaccagtgagctcatatctgagctattcaatgattgtggggctcttgagtcttctcagctctgtgactacatcaatgaccccaacatgactcggcctgtggatgacattccggaccggccagctggggttggagtttacacagccatgtggcagctggccttggcactgatcttcaaaatagtcattactatatttacctttggcatgaagattccctcaggtctcttcatccccagtatggctgtaggagccatggcaggccggatggtgggaattggtgtggagcagctggcctaccatcatcatgactggatcatcttcaggaactggtgcaggcctggagcggactgtgtcacaccagggctttatgcgatggtgggagctgcagcctgtctaggtggagtgactaggatgacagtgtctctggtagtcatcatgtttgaactgactggaggtctggaatatattgtacccctgatggcagcggctgttaccagcaagtgggtggctgatgcctttgggaaagaagggatttatgaagcccacatccatctgaatgggtacccatttcttgatgtgaaggatgagttcactcaccgtaccctagccactgatgtgatgcggccccgcaggggagaaccacctttgtcagtactaacccaggacagcatgactgtggaggatgtggagactctcataaaagagacagactacaatgggtttcctgtggtggtctcgagagattcggagcgcctcataggctttgcccagaggcgggagctaatcttggctataaaaaatgccagacagaggcaagagggcatcgtgagcaattccatcatgtacttcacagaggagccccctgagctgcctgccaacagcccacatccactgaagctgaggcgcattctgaacctgagcccttttactgtcacagaccacacccccatggagacagtggtggacattttccggaaactggggctccgacaatgcctggtgacacggagtgggaggcttcttgggatcatcacaaaaaaagacgttctgagacacatggcgcagatggcaaaccaggaccctgaatccatcatttttaattag

SEQ ID NO: 2097 - DNA, 1050 bp, Rattus norvegicus
  Genbank Accession No. NM_022205
atggaaatatacacttcggataactactccgaagaagtagggtctggagactatgactccaacaaggaaccctgcttccgggatgaaaacgaaaacttcaacaggatcttcctgcccaccatctattttatcatcttcttgactggcatagtgggcaatgggttggtaatcctggtcatgggttaccagaagaagctgaggagcatgacagacaagtaccggctgcacctgtccgtggctgacctcctctttgtcatcacactccccttctgggcagtggacgccatggctgactggtactttgggaaatttttatgtaaggctgtgcatatcatctacaccgtcaacctttacagcagtgttctcatcctggccttcatcagcctggaccgctaccttgccattgtccacgccaccaacagccagagcgcgaggaagctgctggctgaaaaggccgtctatgtgggtgtctggatccccgccctcctcctgactatccctgacatcatcttcgccgatgtcagccagggggacggcaggtacatctgtgaccgcctttaccccgacagcctgtggatggtggtgttccagttccagcacatcatggtgggtctcatcctgccgggcatcgtcatcctgtcctgttactgcatcatcatctccaagctgtcacactccaagggccaccagaagcgcaaggccctcaagactacggtcatccttatcctggctttctttgcctgctggctaccgtattacgtggggatcagcatcgattccttcatccttttggaggtcatcaagcaaggatgtgagttcgagagcgtcgtgcacaagtggatctccatcacggaggccctcgccttcttccactgttgcctgaaccccatcctctacgccttcctcggggccaaattcaagagctccgcgcagcatgcactcaattccatgagcagaggctccagcctcaagatcctttccaaagggaaacggggtggacactcttccgtctccacagagtcagaatcctcaagttttcactccagctaa

SEQ ID NO: 2098 - DNA, 832 bp, Rattus norvegicus
  Genbank Accession No. NM_022239
ctttggtgtctgagctcagcaagaggcgctcgggggacgctgagggacagctttaacacccgcacaacacagggtacctggttcccagtccagagctgcttggagggcagagatgtcgcgagcagctaatcgccgcccagggctctccgcaggacaattggccgctgcaactgcatctcctctcctgtcactgctgctgctgctcgcctgctgtgcggacgcttgcagaggtacgccaatatcgcctcaaagattaccaccagaacaagaactacaattgtggaatgagattcctgaagcttgtgcgtcctttctgtctgttgattcccagcctcaggcatctgttgcattgaggaagctttgccgtgtcctgatggagattttccagaagcctcaggagcaaactgagaaagataatgctaagaggttcttatttcattattcaaagacacagaagttgggaaattcaaatgttgtgtcgtctgtcgtgcatccgttgctgcagctcgttcctcaactgcatgagagaagaatgaagagatacaaagtgaatgaataccagggtcctgtagctccaagtgggggattctttttatttaggccacgcaatgggaagaggtcaacaagtttcatttaaaatggatgccaaatgatcttttcattgaaaactctgctatgggatataaaatgtactcacattttgttctcaaaaaaaaaaaaatgatccctccgaaatgtagtctgttgcaaacccctgtattgtaacattctctgccatggttgagattatgaatgtttaatttgttgaaaataaaacagcatcttgaaatgt

SEQ ID NO: 2099 - DNA, 751 bp, Rattus norvegicus
  Genbank Accession No. NM_022245
tccggcccgggacattgcactaccctgcaagctgtgttgcagggcccggaaggctcactgttccgaaatggccgagcagtcagacaaggatgtgaagtactacactctggaggagattcagaagcacaaagacagcaagagcacctgggtgatcctacatcataaggtgtacgatctgaccaagtttctcgaagagcatcctggtggggaagaagtcctaagagagcaagctgggggtgatgctactgagaactttgaggacgtcgggcactctacggatgcacgagaactgtccaaaacatacatcatcggggagctccatccagatgacagatcaaagatagccaagccttcggaaacccttatcactactgtcgagtctaattccagttggtggaccaactgggtgatcccagccatctcagccctggtggtagctctgatgtatcgcctctacatggcagaagattaacctgtctgtccgaagccaaggaaggaaaagactgccccagagaggggagaaaagaagccagtgttaatcacttccactgacagaaaccctccccctgagaatgtaattgtaatatatctgtctccctctcctcctatgctaggagaacaaagatgggactctttgtactcttaaactttcaaatgtgcctttttactcaacttcattttgacatttcttcactacgtaatttacttattgtaaacatgatctttttaaataatatctggcttgtaaagt

SEQ ID NO: 2100 - DNA, 4075 bp, Rattus norvegicus
  Genbank Accession No. NM_022251
tcgaggctgacagaggtttggcaaaatctccacctctcccaacccccacatccctgcccgcgttagccgataggctcaagccctgttttatatttaactcactccagttcaggaggggcgggcctggggagacgctgtttatacagagctgggccaacactctcatccgtcctcctccgtcaagtcagcctctcttctgagccttcatcccactgcttggtttccgcattcatcccagagtggccggtgaggacgtgcaggactgggaagagacaccggacaccagacagagaggtgtgggaaagcgaagtcaggctgccaaactaggggacgccttccaattgaaaagggaagtcagctgacgatagttagttaaatttaacatcctttcatgggtagtatctgacttcaggggagaaaaatgaactttgcagaggaagagccctctaagaaatactgcattaaaggcaaacacgtggccatcatctgcgcaacggtggtagcagtgggattaatagtaggactttctgtgggcttgaccaggtcgtgtgagccgggcacaacccccgctccttccaaccctcctccccacaccagcactgccctgcctccccaggatcagaatgtctgccctgacagtgacgatgaaagtggagaatggaaaaacttcaggctgccggacttcatccagccagttcactacgacctggaggtgaaggtcctaatggaggaagacaggtacacgggcatagtgagcatctctgtcaacttgagcaaagacactcgtgacctatggctgcacatcagggaaaccaggatcaccaagctgccggagctaaggaggccctccggggagcaggtaccgattcgacggtgctttgagtacaagaagcaggagtacgtggtgattcaggctgaagaagaccttgcggccaccagcggggacagtgtctatcggctgaccatagagtttgaaggctggttgaacggctcccttgtgggtttttacagaaccacctacacggaggacgggcaaaccaagagcatagcggccactgaccatgaaccaacagatgccaggaagtccttcccttgtttcgatgaacccaacaagaaggcgacttacaacatatccctcattcacccgaaagaatactcagcactttccaatatgccagtagagaaggaagagacactggataacgactggaagaaaaccactttcatgaagtccgtcccgatgagcacttacctggtgtgctttgctgtacatcagttcacctcgatacagagaacatccaggagtggcaaaccactcactgtttacgtccagcccaagcaaaagcaaacagcagagtatgcagcaaacataaccaaagctgtgtttgacttctttgaagactacttcgctatggagtattctcttccgaaactggataaaattgctattccagattttggcaccggcgccatggaaaactggggacttgtcacttaccgagaaacaaacctgctttatgaccccctgctatcggcctcatccaaccagcagagagtagccagcgtggttgcccacgagctcgtgcaccagtggtttggaaatatcgtgaccatggactggtgggacgacttgtggctaaatgaaggatttgcttcgttcttcgagttcttgggagtaaaccacgcagaagcagactggcagatgctcagtcaggtgctgcttgaagacgtgctacctgtgcaggaggatgactccctgatgtcctcacatccggtggttgtcacggtgtctactccagctgaaataacgtctgtgttcgatggaatatcatacagcaagggagcttctatcctgagaatgcttcaagactggataacaccagagaaattccaaaaggggtgtcagatttacttggaaaacttcaagttcaagaacgcgaaaacttccgacttttgggattcactggaaaaggcaagtaatcaaccagtgaaagaagtaatggacacctggactagccagatgggctatcctgtggttactgtgagtggaaagcagaacgtcacccagaaacgctttctgttggactacaaagctgacccttcccagccaccgtcagcacttggttacacatggaatattccaatcaaatggaccgaaaatggcaattcaaatatcacagtctactataggtcaaacagagaaggaatcactttgaatgctaatcttagcggagatggttttcttaaaataaacccagatcacattgggttttatcgtgtaaactatgaagcagaaacttgggattggatagctgagactctctcctcaaaccacatgaacttctcttctgctgaccggtcaagttttatcgatgatgcttttgctctggcaagagctcaacttctggattatgagaaggccctgaacttgaccaggtatctcacatcagaaaaggatttcttaccatgggagagagtcatttcagctgtaagctacatcattagcatgtttgaagatgacagagagctgtaccccctgatagagacatacttccgaagccaagtgaagcccattgcggattctctgggatggcaggataccggaagccacatcacaaagttactccgggcctctgtattaggattcgcatgcaagatgggagacggagaagccttgggcaatgcttcccagttatttgaggcctggctgaaagggaatgaaagcattcctgtgaacctcaggctgctggtgtatcgctatggaatgcagaactctggcaatgaggcagcgtggaactatactctagagcagtaccagaaaacatctctagcacaagagaaagaaaagctgctctatgggttagcttcggtgaaggatgttacactcttggcaaggtatctggaaatgctcaaagaccccaatattattaaaactcaggacgtatttacagtcatccgctacatctcctacaacagctatgggaaaagcatggcctggaactggatccaactcaactgggactatctggtcaacagatttacaatcaacgacagataccttggccggatcgtcaccatagccgagcccttcaacactgagctgcagctctggcagatgcagagcttctttgcaaaatatccaaatgctggcgctggagcaaaacccagagagcaagtgctggaaacggtgaagaacaacatcgagtggctaaaactgaacagaaagtccatcagcgagtggttcaccagcatgccctaggagcgctgatgccttccgtttgtgcctccgctgcactgtggaacctgaggcgacctgttttacagactgcagagggagccttcaaaaccagttctgcttttgctaagtaccgtgtttatgtctcgcaaagctttttaaattattcctctttgtcgttgaaggaagatactaatagagtatttaatatactcagggatttctgctaagtgtactttatagggatgtctttacaaactgaagggtttaatagtcacattaatgtctttaaatatcattccttgtatcttaaatctgtgaaaatggagcaatttggtcccagctttacattttcagtaccaaagaaacaccacttaatcttctctcctgattgatttttaaagtttaaataccagtacgtgcaggacgtattgccatcttaatctttattttattattcagaattacatagacctaatatcattttattcacaaacgtctcactgctttaaatcctaccaaagtaaccttggcttaagttttggtgcaaacggatgtatctgcatgttggaaagctcgcaggaggcatgttggcaagatgagagtgcatgtttgggattactggggcttactgtccccacgccgggcggaagcttccagagatgtcttatagacaggtgtgtgaaggctgagagacagagtttggagccgtaacgtgtttgaaacaggaaagagtcagttctcggtggttaaaaatgagaggtttgcaggggatttttggtattcgacagccaagagtcagccagagaaaactcactcaccgggcccaacccggctttc

SEQ ID NO: 2101 - DNA, 2345 bp, Rattus norvegicus
  Genbank Accession No. NM_022266
cacagctcttctctccaagaagactcagccagacccactccagctccgaccctaggagaccgacctcctccagacggcagcagccccagcccagtggacaaccccaggagccaccacctggagcgtccggacaccaacctccgccccgagaccgagtccaggctccggccgcgcccctcgtcgcctctgcaccccgctgtgcgtcctcctgccgcgccccgaccatgctcgcctccgtcgcgggtcccgttagcctcgccttggtgctcctcctctgcacccggcctgccaccggccaggactgcagcgcgcagtgtcagtgcgcagctgaagcggcgccgcgctgccccgccggcgtgagcctggtgctggacggctgcggctgctgccgcgtctgcgccaagcagctgggagaactgtgcacggagcgtgatccctgcgacccacacaagggtctcttctgcgacttcggctcccccgccaaccgcaagattggcgtgtgcactgccaaagatggtgcaccctgtgtcttcggtgggtccgtgtaccgcagcggcgagtccttccaaagcagttgcaaataccagtgcacttgcctggatggggccgtgggctgtgtgcccctgtgcagcatggacgtgcgcctgcccagccctgactgccccttcccgagaagggtcaagctgcccgggaaatgctgtgaggagtgggtgtgtgatgagcccaaggaccgcacagtggttggccctgccctagctgcctaccgactggaagacacatttggccctgacccaactatgatgcgagccaactgcctggtccagaccacagagtggagcgcctgttctaagacctgtgggatgggcatctccacccgggttaccaatgacaataccttctgcaggctggagaagcagagtcgtctctgcatggtcaggccctgtgaagctgacctagaggaaaacattaagaagggcaaaaagtgcatccggacgcctaaaattgccaagcctgtcaagtttgagctttctggctgcaccagtgtgaagacctaccgggctaagttctgtggggtgtgcacggacggccgctgctgcacaccgcacagaaccaccacactgccggtggagttcaagtgccccgatggcgagatcatgaaaaagaacatgatgttcatcaagacctgtgcctgccattacaactgtcccggggacaatgacatctttgagtccttgtactacaggaagatgtatggagacatggcgtaaagccagggagtaagggacacgaactcatttagactataacttgaactgagttacatctcattttcttctgtaaaaaaacaaaaaggattacagtagcacattaatttaaatctgggttcctaactgctgtgggagaaaacaccccaccgaagtgagaaccgtgtgtcattgtcatgcaaatagcctgtcaatctcagacactggtttcgagacagtttagacttgacagttgttcactagcgcacagtgacagaacgcacactaaggtgagcctcctggaagagtggagatgccaggagaaagacaggtactagctgaggtcattttaaaagcagcgatatgcctactttttggagtgtgacaggggagggacattatagcttgcttgcagacagacctgctctagcaagagctgggtgtgtgtcctccactcggtgaggctgaagccagctattctttcagtaagaacagcagtttcagcgctgacattctgattccagtgacactggtcgggagtcagaaccttgtctattagactggacagcttgtggcaagtgaatttgccggtaacaagccagatttttatggatcttgtaaatattgtggataaatatatatatttgtacagttatctaagttaatttaaagacgtttgtgcctattgttcttgttttaagtgcttttggaatttttaaactgatagcctcaaactccaaacaccatcgataggacataaagcttgtctgtgattcaaaacaaaggagatactgcagtggaaactgtaacctgagtgactgtctgtcagaacatatggtacgtagacggtaaagcaatggatcagaagtcagatttctagtaggaaatgtaaaatcactgttggcgaacaaatggcctttattaagaaatggcttgctcagggtaactggtcagatttccacgaggaagtgtttgctgcttctttgactatgactggtttgggaggcagtttatttgttgagagtgtgaccaaaagttacatgtttgcacctttctagttgaaaataaagtatatatatttttataaaaaaaaaaaaaaaa

SEQ ID NO: 2102 - DNA, 1773 bp, Rattus norvegicus
  Genbank Accession No. NM_022289
cgcccgggcaagtcgcgggaacctgcctgggtggctgtgccaaggcacagagtggctcgtctccagcggagggtcacatgaggagtccgagtgtccgggcaggacgggaccagccgtagtcgaagaggagccgccttcctccactcggcagcgcggggtcgcggagcgcaccaagatagtgaattcctgagaagaaaacaatgaactgcatcttggttgttctttaagtatttggacttaaaggtatacaagtttgttgccaagaccaaagaagatggcaaccccttatgtcccagttccgatgccaatcggagactctgcttccagctttacaaacaatagaaatcagaggagctcttcctttggcagtgtgtcaacaagctcaaactcttccaaaggccagctagaagactcaagtgtgggcacttgtaggcacacgaatgtccaggatcagatggacagtgcatcatcagtctgcggcagtcctctcattagaactaaatttacaggtacagattcgtccattgaatattctgctagaccaagagacactgaagaacagcaccctgatgcactgaattgggaagatagaccctcaacacctacaattctgggttatgaagttatggaagagcgggccaaatttactgtatataaaatcctagtaaagaaaagtccagaagaaagctgggtagttttcagaagatacactgacttctccaggcttaatgacaaattaaaagagatgtttccaggctttcgattagcacttcctccaaaacgctggtttaaagataattacaatgcagactttctagaagacagacaattaggactacaagcgtttcttcaaaacttagtagctcacaaagacatcgctaactgccttgcagtgagagaatttctttgtctggatgatccaccaggtccatttgatagcctagaagaaagcagggctttctgtgagactttagaagagactaactaccatttacagagagaactacgtgagaagcaaaaagaggtggaatccctgaagaaactgcttggggaaaagcaacttcacatagatgcgttagagaccagaatcagaacattgtccttagaaccgggagcatcactgtatgtgtcgagagcagaaggtggacagatcctaagggtgcagtcctctgtacttcaagtcaatcgggatgtcttggatgaagaatctagagctgatcataagccacacttcaactctagagaagccggaagtgcaatagcagacatagaagtcgcacagttggcatataatgctgaagatgactaacacactggtgactgctccctccatttcatcattttagcagatttcagcagagtggcaaatgccaccctcaaagactgaaacagaagagaacaagaatgcacgtgtataaagtttacataatttgtttttttagttattggataggaactgtattcactgctgctttcgatatcttttatccagcgttgtatttactacattgaaaaaatatacagttagaattgttatcaagacccatgttcttaaaaactttacataaattattacagtgtcttgcctgtatattgctccaaactactgtgttagtgtatatgtgtgtgcttgcttgtcctaaatcaccacttatattaggtgaaaattaattgcatgttagaatctgggtaatttctctatctcagatatgatatagatttaaatcagtgaacaccacaggaaagataaataagaatccagtttgaaatgtt

SEQ ID NO: 2103 - DNA, 4274 bp, Rattus norvegicus
  Genbank Accession No. NM_022294
ccacaggctgagactagagtccaggctgtttgggtgaaggggcctggcggccggacgtggcctgcagagtctgggctgtgcacacattcacacaaaagaggccgggaagtgacaggaggaagctgtgcgtcacaagggactgagcgggaccctgccgcgcctgcccagctccaggacagaccccaactcttgccttcagcgctctgcggagccagccagctccacccggcttccaatgagactcctcctgcttctagtgggtctctccactttgctgaatcactcctacacacaaaactgcaagacaccgtgtctcccaaatgccaagtgtgaggtgttggacgaagtggcagcctgcttctgcagtacaggctacactgggaatggcatcacgatttgtgaagatgtagacgagtgcaacgagacctccgtctgcggtgatcacgctgtgtgtgaaaacacgaatggaggatttagctgcttctgcgtggaaggttatcagacctccaccgggaagacgcagttcacgcctaatgatggctcttactgccaagatgtagacgagtgcaacgagacctccgtctgcggtgatcacgctgtgtgtgaaaacacgaacggaggatttagctgcttctgcgtggaaggttatcagacctccaccgggaagacgcagttcacgcctaatgatggctcttactgccaagaaattgtgaattcaaattgccacttagagcatgactgcattgctgcaaacattaataaaactctaaaaagaattggacccataacagaacagctgactttactccatgaaatctacaagaattctgaggctgagctttctctggtggatatagtcacatacatagagatactaacagaatcatcctcactacaaggctacataaagaacaccacttcgcccaaggatgcctacttcggttcagctcttactgaatttggaaaaaccgtcaataattttgttgaaaagaacacacatgaaatgtgggaccagttacctacaaatcgtagaagactccatctcacaaaactgatgcacgctgctgagcacgtcaccttacagatctctcagaacatccagaagaatactcagtttgacatgaattctaccgacttggctctcaaggttttcgtttttgattcagttcacatgaagcatactcatccccatatgaatgtggacggaggctatgtaaaaatatccccgaggagaaaatctgcatatgacccaaatggcaacgtcattgttgcattcctgtgctataggagcattggccccttgctttcctcatctgacgacttcttactgggcgctcagagtgacaattccaaaggaaaggagaaggtcatttcttcagtgatttctgcctcaattagctcaaacccacccacactgtatgaacttgaaaaaattacatttacactgagtcatgtaaagctctcagataagcaccagacacagtgcgccttttggaactactcagtcgatgacatgaacaatggcagctggtcatctgagggctgtgagctgacatactccaacgacacccatacttcctgccgatgtagtcatctgacacactttgcgattttgatgtcccccagtacctccattgaagttaaagattacaatatcctgacgaggatcactcagctgggaataatcatctccctgatctgcctcgccatatgcattttcaccttctggttcttcagtgagattcaaagcaccaggaccacaatccacaagaatctctgctgcagcctctttcttgcacaactagtttttcttgtcggcatcaacataaacacaaacaagctggtctgctctatcatcgctggcctgctccattacttcttcttagctgcctttgcctggatgtgcattgaaggcatctacctatacctcatcgttgttgggctcatctataacaaggggtttttacacaagaacttctatatctttggctatcttagcccggctgtagttgttggattctcggcctctttgggatacagatattatggtaccaccaaagtatgttggttgagcactgaaaacaactttatctggagcttcatagggccagcgtgtctaatcattcttgttaatctcttggcttttggagttatcatatacaaagtgttccgccacactgctggactgaagccagaagttagttgctacgagaacataaggtcttgcgccagaggagccctggccctcctcttccttctgggtaccacctggacctttggggttctccacgtagtgcatgcatctgttgtgacagcctacctcttcacagtcagcaacgctttccaagggatgtttattttcttattcctatgtgttttatctagaaagattcaagaagaatattacagattgttcaaaaatgtcccctgctgttttgaatgtttaagataaacaacgagaagacacaataattatagctgaaatgaaatggaaattccaagatttcggatagcctgtgtgacaaaaatgagcctgccttcattgttagtaattaatttcaaattcgcttttctgttcgcagtataaaagatgtagttaatgtgagataaaattatgggccagagagctcctgtgtgttttcctacatgacatagttagatatgtcaaaaatagtactgcagatatttggaaagtaattggtttctctggagtgatatcactgtgcccaaggaaagatttctttctaacacaagaaatagatgaatgtcctcaaggaagcgactggcttgatatctttgtgactcatgttgcctttcaaacgagtcccctaccaccatagtaatgagttcctttgcagaaaggagagtataagaaacttggaggggcagaatatgaagcaatggagaagccttctctgacaaggaattgtcattccaataaaattggctttctccaaaattgaagaggaaaaaattttcaggctaaaataacgaaaaaggaaatgcatcctagcactttgggaattggtctgaacttaaaaggcccagacctaaatttactacatccatgttcttccttactgttctaaaccaaagaaaaaccttaaaatttacagatacatggatgagtgttctcacataacatcatatttgaatgtaaatttttttcattcctcacagattaagacttcagcaacatatttggtaaaacataaatttgtcaaactataagactgttcatatctttagtgaaaaaatagaatgtgaagtattttgtctataatattttactgttatgaaaataatcttttcatattagagcagtatacttgaatactttactgtttttaatcttacaaatagtgtgattcatgttgcaaccagcccttttaattgactgtatttaaaagggcattataaatttaaactattgatgaagtaaattataatggttttctgatcagaaaatacatacttaaagcattatttataacaaataaaaagtcactgagcactgcaggggtttcacagtggatctgatatttttagaccgtttcctatcacctatcagtctatttacttaaatgtacagctctaccaattctcttactcaaaggaagaggcagtatttttctcagaagtgagtcattgttctgtaccttcctggagacatgattcgatccattgaacattgtggttttaattcttgtgctgttgaatgaagcctgacaagacacctcctaaaaaatgaaatgtcagctggatgaagcagccctgctactgcctgactgagttgttctctcaggaaagaccactcacctgccaagaagcacgttgcatctctacagatctcagggtttctcccatgccaagtctgtagcccacgagcatcattgtcattctaagatgggactgtagaaataggatatcaaaacataatccgttcaatcaatggataagaaactatcacatgtagtagacagaataacccttctcaaatattcatacactcctcttcacaagctgtggccgtggtggatagtgaggagcaggaggtcctgtcaggaggaagagtagctgaggtccactcagttggagaaggctctcactgtgctgggggaagtcagcatgctgacgatgttactttagtttgggtctcttgttttggacatctcatttctagagctgtaaagacaataaaattctattatcaaagccaaaaaaaaaaaaaaaaaaaaaaaaaaaaaaaaaaaaaaaaaaaaaaaaaaaaaaaa

SEQ ID NO: 2104 - DNA, 3008 bp, Rattus norvegicus
  Genbank Accession No. NM_022297
  misc_feature (1)..(3008): n = a or c or g or t
ccacatgatttattacaatcatctcctcaatagccacactatttattttatttcaattaaaaatttcttcccaaacctttcctgcacctccctcacccaaaactatagccacagaaaaaacgaataacccttgagaatcaaaatgaacgaaaatctatttgcctctttcattacccccacaataataggtctaccaattgttgtgaccattattatgttcccatcaattctattcccatcatcagaacgcctaatcagcaaccgactacactcatttcaacactgactaatcaaacttatcatcaaacaaataatgttaatcggagccgccgggcgctcgcaggctcgcaggctcgcaggttgggcgcgcgctgctctcgggaagacccggccaccgagccaaaccccgccgccgcctctccgcgcgagccatggccggcctcagccacccctcggtcttcggccgggccacccacgccgtggtgcgggctccgcccgagtccctgtgccgccacgcgctgaggcgctcccagggcgaagaggtggatttcgctcgcgctgagcgccagcaccagctctacgtgggcgtgctgggcagcaagctggggctgcaggtggtgcagctgccggccgacgagagcctgcctgactgcgtgttcgtggaggacgtggccgtggtgtgcgaggagaccgccctcatcacccgccccggggcgcctagccgcaggaaggaggttgacatgatgaaagaggctttggaaaaacttcagctcaacatagtagagatgaaagatgaaaatgcaaccttagatggtggggacgtcctattcacaggcagagagttttttgtgggcctttccaaaaggacaaatcaacgaggtgctgagatcttggctgatactttcaaggactacgcagtttccacagtccccgtggccgattctttgcatttaaagagtttctgcagcatggctggccccaacctgatcgcaatagggtccagtgaatctgcgcagaaggccctcaagatcatgcaacagatgagtgaccaccgttatgacaagctcactgtaccggacgacatggccgccaactgtatatatttaaatatccccagcaaagggcatgtcttgctgcaccgaaccccagaagagtacccagaaagcgcaaaggtttatgagaagctcaaggaccatctactgatccctgtgagcaattctgagatggaaaaggtggacggcttgctcacctgctgctccgtttttattaacaagaagacagactcttgagcggaagagtccctcccgagcggccggcgagtggcctaggccaggctgatgatggctctgtacccattcctcctgtttcctttgacaatctactgtgccactaactcttgtttacaaagaattccaatcttaatcgcctcatttccccacacccccctcttcctcacggggccccctaacctgtgcacacatttgctcaatgaactaagcaacctaggaaatacagaactaacgaatcattggaatgtgattgatagcgtggaggcactcactccagcctctgtgtccttagtgtgggaatagtttagatgcagggcatcctgaaggactgacctcctgggcagacagataaacaagcaagggactttctttgcttcatgagttgcgtttggttcctgtgagagtcctgagaacgtggattttttcccattcccctctcttctcacctctaaaacactttcttccaggtcttcctttggccttcctcacttctttcgtaatcaccttgaacctggatttatccaaggtctcgaactctggataccctcctaacgtccaccctgtctacgtgcagtcctctcctcctcacagccacaacttctgccaccaccagcaaatcagagtggctggttggagacgaggaacctcacagaggcacatcctgacagggtttcccattagcacacctaggaaggtaaattcaggtggttgatacaggatgttagatacagaagcctagaaacacccccatgggtacatctcagagagactgagtcactgccatgattttgcctcatgactggtcctataggagcgtggaggaaagtctttctccaccccaccacctccccctttttcagcttccttctgactcaaccttgtatctacccccttagaatcaccatgattttgaaaagtcatttccttcaaaagaggcagaacatctaatgattgttgacggtctggtaagagctagagggaactgcctccacccaaggcctaggagcacaatcaggaaatggttcctaaagtcaacttcaaacaatgtgtgagtctcctttgaaatatccatgactgtttactgtggaattcaaccgaaacttcaaattacacaactttcannagacgcaggtctctcacagggaacaataccacagcaaaggaattcctttcttgaaagctgaaacaggccaaggacatggtaccttacaaggcacggtgacccagccaggcatctcatcaaacttctggtcacttctaccttggctgtatagcctgcagtctgtcattcgatatttaaagttggggagacaaaggctatgtcagctctagctctccttacctctctttgtgatcagtgtttcttctagtgaaggcaagagagactgggcctcatctcgtccccctcagtggccggaagtgagaaaatcaagacttcctttaccgcccttctcttagttggcaacctctctgaagaggtctccatctctcccttgctgtctaactctagactcatatcgcatgccaatatctaactgtacaccctgtgaatgaaccatatcctggtcactgtcacatttcacagcgtatcacaggtgaacagttatgccttctccagggcaagggaatatgagacagttgcctaaattcataaagaaaaattgttctcagccattatggttgccttgaggggttaaagttgaccccacctacactagc

SEQ ID NO: 2105 - DNA, 1617 bp, Rattus norvegicus
  Genbank Accession No. NM_022298
gcgctgtaagaagcaacacctcctcctcgcctccgccatccacccggcagccgcgaagcagcaaccatgcgtgagtgtatctccatccacgtcggccaggctggtgtccagatcggcaatgcctgctgggagctctactgcctggaacatggcatccagcctgatggccagatgccaagcgacaagaccattgggggaggagatgactccttcaacaccttcttcagtgagacaggagctggcaagcacgtgccccgggcggtgttcgtagacctggaacccacagttattgatgaagttcgcactggcacctaccgccagctcttccacccagagcagctcatcacaggcaaggaagatgctgccaataactatgcccgtggccactacaccattggcaaggagatcattgaccttgtcttggacagaattcgcaagctggctgaccagtgcacgggtctccagggcttcttggttttccacagctttggtgggggaactggctctgggttcacctccctgctgatggagaggctctctgtcgactacggaaagaagtccaagctggagttctccatttacccagccccccaggtttccactgctgtggttgagccctacaattccatcctcaccacccacaccaccctggagcactctgattgtgccttcatggtagacaatgaggccatctatgacatctgtcgtagaaacctcgacattgagcgcccaacctacactaacttaaacaggttgataggtcaaattgtgtcttccatcactgcttccctcagatttgatggggccctgaatgttgatctgacagaattccagaccaacctggtgccctaccctcgcatccacttccctctggccacttatgcccctgtcatctctgctgagaaagcctaccatgaacagctttctgtagcagagatcaccaatgcctgctttgagccagccaaccagatggtgaaatgtgaccctcgccatggtaaatacatggcttgctgcctgctgtaccgtggtgatgtggtccccaaagatgtcaatgctgccattgccaccatcaagaccaagcgtaccatccagtttgtggactggtgccccactggcttcaaggttggcattaattaccagcctcccactgtggtccctggtggcgacctggccaaggtccagagagctgtgtgtatgctgagcaacaccacagccattgctgaggcctgggctcgcctggatcacaagtttgatctgatgtatgccaagcgtgcctttgtgcactggtacgtgggtgagggcatggaggagggagagttctctgaggcccgtgaggacatggctgccctagagaaggattatgaggaggttggtgtggattctgtggagggtgagggtgaggaagaaggagaggaatactaaattaaatgtcacaaggtgctgctttcacagggatgtttattctggtccaacatagaaagttgtgggctgatcagttaatttgtatgtggcaatgtgtgctttcatacagttactgactttaagtgtgaatgatttgtcagagacccgagccgtccacttcactgatgggttttaaataaaatactccctgtctta

SEQ ID NO: 2106 - DNA, 1024 bp, Rattus norvegicus
  Genbank Accession No. NM_022300
gggggctgcagcggcggcggcagtagcggcagcggcggcggcggcggcggcagcgctccaactcgctccacgctccggctccgccgtcgagccgggagagagagagcctttgctgagcggccaggcactcggccggacgacaccagacacccgggccccttggaggcaccgcgctcacccagggccggcacagcgacccaaagccgaactccaagatgggaagcaagctgagcaagaagaagaagggctacaatgtgaacgacgagaaggccaaggacaaagacaagaaggctgaaggcgcgggcaccgaggaggaggggacccagaaggagagcgaaccccaggcggccgccgacgccaccgaggtcaaggagagcgcggaggagaagcccaaggacgcggcggacggcgaggccaaggcggaggaaaaggaggccgacaaggcggcggccaaggaggaggcgcccaaggccgagcccgagaagagcgagggcgccgcggaggagcagcccgagcccgcgccggcgcccgagcaggaggcggccgcgcccgggcccgctgcgggcggcgaggcccccaaggccggcgaggcgagcgcggagagcacgggcgcggccgacggcgcgccccaggaggagggcgaggccaaaaagactgaggctcccgccgccggccccgaagcgaaaagcgacgcggccccggcggcttcagactctaaacctagcacggagcccgcgccctcgtccaaggagacgcccgcggcctccgaggcgcccagttccgccgccaaggcccccgcgcccgccgcgcctgccgccgagccccaggccgaggcacccgtcgccagctccgagcaaagcgtggccgtcaaagagtaaccgggacagcctagccagaaccgacgccactcgcaaacgacctgtctcacgctctctctgtctctcactctgtcctctctctgtctctctatcctatactaacttgtttcaaattggaagtgaggatatgtattgcccaagggatt

SEQ ID NO: 2107 - DNA, 1160 bp, Rattus norvegicus
  Genbank Accession No. NM_022381
ttgtcagcaagacctcgctccccttacagtaactctcatctagacgtcgcaactccgccaccatgtttgaggcacgcctgatccagggctccatcctgaagaaggtgctggaggccctcaaagacctcatcaatgaggcctgctgggacatcagttcgggcggcgtgaacctacagagcatggattcgtctcacgtctccttagtgcagcttactctgcgctccgaaggcttcgacacataccgctgcgatcgcaacctggccatgggcgtgaacctcaccagcatgtccaaaattctaaaatgtgctggtaatgaagacatcattacattaagggctgaagataatgctgataccttagcactagtatttgaagcaccaaatcaagagaaagtttcagactatgagatgaagttaatggacttagacgttgagcaacttggaatcccagaacaggagtacagctgcgtagtaaagatgccatctggtgaatttgcacgtatatgccgggaccttagccatattggagatgctgtggtgatctcctgtgcaaaggacggggtgaagttttctgcgagtggggagcttggcaatgggaacattaagttgtcccagacaagcaatgttgataaagaagaggaagctgtgtccatagagatgaatgagccagttcagctaacttttgctctgaggtacctgaactttttcacaaaagccactccactgtctcctacagtaacactcagtatgtctgcagatgtaccccttgttgtagagtataaaattgctgacatgggacacttaaagtattatttggctcccaagatcgaagatgaagaaggatcttaggcgttgctagaaattgagaaactaaacctttgacgatcgcttctgagatgccagcgtgttctgaggtcttttctgtcaccaagtttgtacctgagtattcttaaatattaaaataaaatgtagatatcttctgtaaataaccttttttttcctctccataatttgcttacagaataagctccaaagtaaaaactggttttgttaacataaatgtctctgccttacaaatactggtgattttcataaatgatcttgacgctaaatgcagttttaagaaatatttttcaatttaaataaagttaactgaatttg

SEQ ID NO: 2108 - DNA, 1362 bp, Rattus norvegicus
  Genbank Accession No. NM_022388
ctcacctagctcgggtcatctccaggggcactgaaacacagaggcattacctactaagtcacacacctggtaagtggatgtgagggaactgagcccagccagtaggtactggatctgtgatctcattagtagaccagagctaagtacagtagatagtaaccgggacttcagaacggaacctttgacaacagctgccattatacagaaagaagggatagggctttttctaaaactcagctacacaagggctatcacatacaacttgtaaatggggcctggaggaggacctggaggaggagaagggggctatgtctcacacactaatagacctttctagcaggtacctgtgctctgagtagatctgaggctgcttggagcaggcagagttcctggctgtagacatggaggctggaactgcaccctccagacctgttgctaaattctgagataatgtgtgacccaacctggttcctctggggccagatcttttcaagagtcaggacccagacacctggttaggaaagcctagcttaggacaagacctctcactcctagggaggacagacatctcccctggagtgtttgattttacctttgtgagttcccacctctgagaaagagatgatagtatctttataaagctcttcacgaagcccaatgtggtcactacagggtgttctgaacacgtaactagaattaagcaatccacatacccaggtaattaatcactagtgccatctgtagatgttaaagcggaaagcaatccttttcttcagataagcgcttgcccatgtggaattcgcatacctaattttcacaccagttctgcctcctcctagtggcgtgagctgtggcaggtcacagatcccagacccacctctgctctgcagcccacccagcagcctgcagcctcgccctgggttgatatggagggaataacctgtgcctttctcctggtgctagcaggtctgcctgtcttggaagccaatggtccagttgataaaggcagtcccttctactacgactgggagagcctgcaactgggaggaatgatctttggggggctcctgtgcatcgctggaattgccatggccctgagtggcaagtgcaaatgtaggcgcaaccatacgcccagttccttacctgagaaagtcactccactcatcactccaggctctgccagtacctgacgaactgaacacaggaccaagtttggaggcagctttttgatgacttcctgctgtatctcccctctggagatcttcctctccaaaatggcttccctagagcacacttaagtcttcagtgacagggaagggtgttccaaagttgattttatattaaactggtcttgctgctctg

SEQ ID NO: 2109 - DNA, 1307 bp, Rattus norvegicus
  Genbank Accession No. NM_022390
gtgcttttgggtttggcgatcagttccgcgggagtcttgtcaggagcaggatggcggcttcgggcgaggcgcgccgagtgctggtgtacggcggcaggggtgctctgggctcgcgctgcgtacaggccttccgggcccgcaactggtgggttgccagcattgatgtggtggagaatgaagaggccagtgccagcgtgattgttaagatgacagattcattcacggagcaggctgaccaggtcactgctgaggtcgggaagctcctaggtgaccagaaggtggatgccattctctgtgtggctggaggatgggccgggggcaatgccaaatccaagtcactctttaaaaactgtgacctgatgtggaagcagagtatttggacatccaccatctctagccacttggccacaaagcacctgaaggaaggaggcctcttgaccctggccggggccaaagctgcgttggatgggactcctgggatgattggctacggcatggccaagggagccgtccatcagctctgccagagccttgcagggaagaacagtggcatgccgtctggggctgccgccattgctgtgcttcccgtcaccctggatactccgatgaacaggaaatcaatgcccgaggcagacttcagctcctggacacccttagagttcctggtggagaccttccatgactggatcactgggaacaaacggccaaactcaggaagcctaatccaggtggtaaccacagacgggaagacagagcttactccagcctatttctaagttgcacctcagtgcccaggagaaccctcttgaaactctactaacctgtgtctgtattgccgcacctggccccatgttgtctgtattcctgtttgtggtacgagataactagtcccgtttgtctcttacgtagtgctccttttttgtcctgggctggtgaggtatgtttatggggaatgagtgggggcctgtaagtagcaccatcagtgctgaggcccagggaggtatgtgtgcaggccgtcatcccagcatcccagactgctttggagacccgtttgatagttcattttttagcatttggggcactttgaaatccaacttgtttttaaattccatgttagtgccatagatgtagtttttgctgcctgaaaattaactgccatgaaaattcattggtgatgtaagtaagcaaaacctaatggactctgttggatatcatttgtgttccagcctaggctaagtgtttatgagaactattcgtgagtgttcggagtgttcttcctaataaacacatttcatgtccccgaattc

SEQ ID NO: 2110 - DNA, 2410 bp, Rattus norvegicus
  Genbank Accession No. NM_022392
tacgctgctttggtggcgtgcacctctcacggtgtgcctagccgccgatgcccaggctgcacgatcacgtctggagctacccaagcgcgggcgctgcgaggccgtacagcctcccgcgaggcatgattgcggcggccctctgtccgcagggccccggagcccccgagcccgagcccgcgccccggggccagcgagagggaaccgcaggcttcagcgcacgacccggcagctggcaccacgacctggtgcagcggagcctcgtgctcttctcatttggcgtggtcctggctctggtgctcaacctgctgcagatccagcggaatgtcacgctcttcccggacgaggtgatagccaccatcttctcctccgcctggtgggtgcccccgtgctgtggcacggcagccgctgttgtcggcttattgtatccctgtattgacagtcacctgggagaaccacacaagttcaagagagagtgggccagtgtcatgcgatgtatcgcggtgtttgttggcatcaaccatgccagtgccaaattagatttcgccaataatgtgcagctgtccctgactctggcagccctatccttgggcttgtggtggacgtttgatcgatcccgaagtggcctggggctcgggatcaccatcgccttcctagccacgctgatcactcagtttcttgtttataatggcgtctaccagtacacgtccccagatttcctctatatccgttcttggctcccttgtatatttttctcaggaggtgtcacagtgggaaacataggacgacagttagctatgggtgttccagaaaagcctcacagtgactgagtttgagcacatgattcagggcggaagcagaatgtggagacactggtcctgggtgtggtgaagaggatctttttctcaatgttccatttagactgggctgatgataaatgactcctaaagatgcgttcacgtagtctaaatagcaagtggaggcaaggactacttacctaaagtcttaccttgctcacccaccctcacacctgtctgcactggaacattctatcccaggctgtatgtgagagttgggtaagggggccggtttcccgagtattagatttcactcatcattcaaagcaaaatgccatatttcaaagccttgaatcaaaatgaattaccaactagcagttttatatcagtgcccaaaggagagaggttgatggtgcttaacagagatgaagtatgtgcagtaagaatatttatccagaattaaaatatagggttgtgtaaagaggggctaagggcagcagtaagttggaggaagatcatgctccccggaggacccagtgcagccacatctccaggtctcgctcaggctggcgctcacacgtgggtctcatcagtgtgggaactatgctgtttactgacaggaggcttgtagacaatcttactgacagcccaggacaacacaaagtcaggattctgcattgcgatgctggacttttcatctcaatttaagtgaagttttatccaagatctggagcatctaagagtgaatagctgtctgctgtttcagtcgtaatgagccgaaattgtgtctctgtcactccagagtggagaggacttttccacagccctatggagcttgcaatctgtgattgccttgtaaaaggttgagtgtgcacgtcactgcgttcggtgcgcagtgtcctgtgtgtgttggacagcgtagaacacatgggaccttgcaagtattgggtcttcaacttcaagtgcaatgtgtatgaaaccaatctgagccttgtattctcttaaatatttattatttttttttaaccgcgcgagctgttctggagaagggttctcgggtcatttcagagctgtgtgaggcacactcagcaatactgtgtcagccgtgacgctccccagtcacaccctccactacaccctagtcctttgacatactccaggtttgtaagtttagtgatttttacttacaaatttacccttttttgcattctaaaattgtgtttaaattatatggaagtacttggtgtaggcagtcattggtccccgggcagcagaagctctgcctgtggaatcgggtttgggttcactctgcagggctcctcatagaggctttgcttatttgttttgaggaaaatgtctggagtaaacctttgttttctgaaactactttagctaaaagaaaatgggtgttctagactttggaatggttcttaaagtttcctggaaataaaaataatgattggcacttcaaagacattctttagccaagacttcagtgtctagcagaaaccacaagtgactagaagagcaagtgatcttggtgatgcacttgattgtatacaatgagtattttttctcttaaactggaaataaatctgttagaaataatatagcca

SEQ ID NO: 2111 - DNA, 1358 bp, Rattus norvegicus
  Genbank Accession No. NM_022393
ccacctctggccactgctgcacagggaagccacgatttcacacagttccaggacttacctcagcttcacactgcttctgacactctccttggtcccagctcagtatctgtctggattctggtgtctcggtttcagttcagatagccctagaggccttgtgtttgtgcaagcatgacaatggcatatgaaaacttccagaacttggggagcgaagagaaaaaccaagaggctggtaaagctcctccccagtccttcctgtgcaatatcctctcttggacccacctcctcctgttctccctgggccttagcctcctgctgctggtggttatctccgtgattggatcccaaaattcccagttaaggagggacctagaaaccctgagaaccactttagacaacaccacctccaacaccaaggctgaactacaggccctggcctccaggggtgacagcttgcaaacaggaatcaattctctgaaagtggaggtggatgatcatgggcaggaactgcaggcaggccgaggcttgagccagaaggtggcttctctggagagcacagtggagaagaaggagcagactctcagaacagatctatctgaaataaccgatcgtgtgcaacagctggggaaggacttgaagaccctgacatgtcagctggccagcctcaagaacaacggctcagcagtggcctgctgcccccttcactggatggagcatgaaggcagctgctactggttctctcagtctgggaagccgtggcctgaagctgacaagtactgccagctggagaattctaacctagtggtggtcaactccctggcggagcagaattttctacagactcacatgggcagtgtggtcacttggattggcctaacggaccaaaatgggccctggcgatgggtggacgggaccgactatgagaaaggctttacgcactgggccccaaagcagccagataactggtatggacacgggctgggaggaggcgaggactgtgcacacttcacctcagatggtcgctggaatgatgacgtttgccagaggccctaccgctgggtctgtgagatgaagctggccaaggacagctaggagcactctccaagtaatttatttcttcagtggttttagctggggaagcctggagtttggactcctcctatcccatttcaatgttatttgggacttttctttttgtcaaaaaatttaagtcaaggagaaaggattgtgtttgagatggtagtgtggtgtccggaagaatggggttattgaaatctgtggtattttgtacagagtgccgcttattgtaggactttttaatgtaacaaaaataaaatactgttggttttaaaaaaaac

SEQ ID NO: 2112 - DNA, 3113 bp, Rattus norvegicus
  Genbank Accession No. NM_022394
ttcaaaaaaaaaataataacaaatccaaaaaacacacccacgcaagcccactgacccggttctgtgtgaagtgggcgacggaaccagggtccctggaatggcggagactctgtcgggtttaggagactcgggtgcggcaagcgcagcggccgtgagctccgcggcgtcagagaccgggacgcggcggctcagcgacctgcgggtgatcgacctgcgggcggagctgcggaagcgaaacctcactcgagcggcaacaagagcgtgctgatggagcggcttaagaaggccattgaagaggaaggtgggaatcctgatgaaattgaagtcatctcagaaggcaacaagaagatgcctaagaggcccagcaaagggaagaaaccagaagacgagggtgtggaggacaacgggctcgaggagaattctggggatgggcaggaggatgtggaaaccagcctggagaacctgcaagacatggatatgatggacatcagtgtgctggatgaggctgacattgataatggcagcgtggcagactgtgtggaggaagaagaggaggccacactccctgagggcctaggactgctccgaattggccgattgcaatcgaaggggctccccgaacagctgcaggagcttgctatagatgacaaggaagccattaacaatgtagatacatcatcatctgacttcaccatcctgcaggagatggaagaggcatctttggagccagaaaatgagaaaatactcgacattttgggggaaacttgtaaatctgagccagtaaaagaagaaggttcggagctggagcagccctttgcccaggccacgagtagcgtggggccagacaggaagctggcggaggaagaggacctatttgagagctgcggccacccggaagaggaagaagaagaggaggaagaagaggagcaggaagaggagcaggaggaggagggagatttagctttggccagcagcagcaagtctgagtcttcaagcactcgatgtcagtggagcgaggcagacgccctgttagcagtagtgaaaagggagccggcagaggcgcctggcggaggcactgggatggaccgcgagcctgtagggctagaggagccagttgaacagagtagcacggctgcccagctcccggagaccaccagccaggagctggtgcgagcgcccacggcagccccgagccctgagccccgagatagcaaagacgacgtgaagaagtttgcttttgacgcttgtaatgacgtccctgcggctcctaaagagtcctcagccagtgagggcgctgatcagaaaatgagttctgtggaagatgactcggatacaaaaaggctttccagagaggagaagggtcgcagcagctgtggtaggaatttctgggttagtggcctttcatctacgaccagagccacagatctgaagaacctttttagcagatacgggaaggtggtgggagctaaggttgtgacgaacgcccggagtcccggagctcgctgttacggctttgtcactatgtccacagctgaagaggcaacaaagtgcattaaccatttgcataagactgagctgcatggcaagatgatctcggtggaaaaggccaaaagtgagcccgctggcaaaagagtacctgacaggcgagatggcgacagcaagaaagagaagaccagcaccagtgacagatctgcaaaccttaagagggaggagaaaggtgacagaaaagacgatgccaagaagacggatgatgggagcacagagaagagcaaggatgcagatgaccaaaagcctgggccttcagagcgctctcgaacaaccaagtcaggaagccgtggcactgagcgtactgtggtgatggacaagtccaaaggtgtgcctgtcatcagtgtgaagacttctggttctaaagagagagcctccaaaagtcaggaccgaaagtctgtcagccgggagaagcggtctgttgtgtcctttgacaaggttaaagagtctcgaaagtccagagactcggagtcacggagggagcgggagcgggagcgcagtgagcgggagcaaaggctgcaggcccagtgggagcgggaggagcgagagcggctggagattgcccgggagcgcctggctttccaccgacataggctggagcgtgaacgcatggagagggaacggttggagcgggagcgcatgcatgtggaacaggagcggaggcgtgagcaagagcgcattcaccgagagcgagaggagcttcggcgtcagcaggaactgcgctatgaacaggagcggaggcctgctgtgcgcaggccctatgaagtagatggccggcgagatgatgcctattggccagaagctaaacgggctgcgctggatgaccgttaccactcagacttcagtcgccaggaccgctttcatgacttcgaccacagagacagaggccgctatcccaaccactctgtggataggagagaaggttcacggtcgatgatgggagacagagaaggacagcattaccctgagcgccatggaggacctgaacgccatggccgggactctcgagatggctggggctatggctcaaacaagagactgagtgaaggccgggggctgccccttcttcccaggcgtgactggggagagcatgcccggagacttgaagatgaccgggcatggcagggcacagctgatggaggcatgatggagcgtgatcaacagagatggcaaggtggtgagaggagcatgtctggccactcagggcccggtcacatgatgaatcgtggtggcatgtcagggcgaggcagttttgcccccggaggagcttcccgtcgccatgtgatcccacgtggagggatgcaggcaggcttcggcgggacagagccggggcagcagacccagtgatgcccgcttcacccccgtattgagcacctaaaccacccaaccatgacctccaagtctttttaggaaaccctcccgccattgtacaaaggatttttttttttttatttgctgccatattgtagcttgttacgatggaatttgttttcatttttgttcctgtttttttgtaataaagggttttgttcaaaaaaaaaaaaaaaaaaaaaaaaaaaaaaaaaaaa

SEQ ID NO: 2113 - DNA, 1570 bp, Rattus norvegicus
  Genbank Accession No. NM_022395
ccctatccacagcagagatggcggcggcggctgtatcccggacgttgttgccggtggccggacggcgcctgtggggatttacgcgaaggcttccgctccgcgccgccgctgctcagccattgtactttggaggggaccgactcagaagtacacaggctgctccacaagttgttctgaatgttcctgagacacaagtcacttgtttggaaaatggactcagggtagcttctgaaaactctgggatctcaacatgcaccgttgggctgtggatcgatgctggcagtcggtatgagaatgaaaagaacaatggcaccgctcactttctggagcacatggctttcaagggcactaaaaagaggtcccagttagaccttgaacttgagattgagaacatgggtgcccatctcaatgcctatacctccagagagcagactgtctactacgccaaagccttctccaaagatttgccaagagctgtagaaattcttgctgacataattcagaacagtacattgggagaggcagagattgaacgtgagcgtggagtcatcctcagagaaatgcaggaagttgagaccaacttgcaagaagttgtctttgattatctgcacgccacagcctatcaaaacaccgcgctcggacggacaattctgggaccaaccgagaacatcaaatctataagccgtaaggacttagtggactacataaccacacattataagggaccaagaatcgtgctggctgctgctggaggtgtttgccataacgaactgctggagttagcgaagtttcattttggtgactctttgtgcgcacacaaaggagatgtaccagctctgcctccctgtaaattcactggaagcgagattcgggtgagggatgacaagatgccactggcgcacctcgcagtggctattgaagcagttggttggacgcacccagacacgatccgtctcatggtcgcaaacacactgataggcaactgggaccgctctttcggaggaggaatgaatttatcgagcaagctggcccagctcacgtgccatggcaatctctgccacagcttccagtccttcaacacctcctacacagacacaggattgtgggggctctatatggtttgtgaacaagccacagttgctgacatgctgcacgctgtacaaaaggaatggatgcgtctgtgcacagctgttagtgagagtgaggtcgcacgcgccaaaaaccttctcaagacaaacatgctgctgcagcttgatgggtcaactccgatctgtgaagacatcggtaggcagatgctatgctacaacaggagaatccccatccctgagcttgaggccaggatcgatgctgtggacgcggagatggttcgagaagtgtgcaccaagtacatttatggcaaaagcccggccattgctgctctcggtcctattgagcgcttaccagattttaaccagatttgtagtaacatgcgctggactcgtgactgatttttgtgatgaattatcctacacatacatatttataaaactgagacctagaagttttgaaagactgctcatcttcaagtgaa

SEQ ID NO: 2114 - DNA, 557 bp, Rattus norvegicus
  Genbank Accession No. NM_022396
gtgacttctgggcccagctctggggcaaagatgcccgcccttcacattgaggatctgccggaaaaggaaaaactgaagatggaggttgagcaacttcgcaaagaagtgaagttgcagagacaacaggtgtctaaatgttctgaggaaataaagaactacattgaagaacgttctggagaggatcctctggtaaagggaattccagaagacaagaatcccttcaaagaaaagggcagctgtgtcatttcctaaggaactctggagggaaattgttttcagttgggtcagattgttcttttgtttaatttttcccccaaatgaagccaaagtgtgtgtgaagaattgaggaaaaatgaaatcgagaaaaagactgtcatataagcactctccaagcactttgtgcatagaacaaacctgcttctcacccacacaccctctctcagaggagagcacctgagtgcagttattggatgaaggcctggctctccctttcaatatactgcttgctgtctccaataaagttttacctcgaaaaaaaaaaaaaaaaaaaaaaaaaa

SEQ ID NO: 2115 - DNA, 946 bp, Rattus norvegicus
  Genbank Accession No. NM_022398
  misc_feature (1)..(946): n = a or c or g or t
atggcggcgacggcgagtcccggggctggccggatggacgggaaaccccgtacctcccctaagtctgtcaagttcctgtttgggggcctggctgggatgggcgctaccgtttttgtgcagcccctggacctggtgaanaaccggatgcagttgagtggtgagggcgctaagactcgagagtacaaaaccagtttccatgccctcactagcatcctgaaggcagaagggctgaggggcatttacactgggttgtcagccggcctactgcgccaggccacctacaccactacacgtcttggtatatatacagtgttgtttgagcgcctgactggggctgacggtacaccccctggctttctcctgaaagccctgattggcatgactgcaggtgcaactggtgcatttgtgggaccaccagctgaggtggccctcatcaggatgactgctgatggccggcttccagctgaccagcgccgtggctacaaaaatgtgtttaatgccctaattagaattgcaagggaagaaggagtccccacactgtggcggggctgcatccctaccatggctcgagctgttgtcgtcaatgctgcccaacttgcttcttactcccaatccaagcaattcttgctggactcaggctacttctctgacaacattctgtgccacttctgcgccatcatgatcagtggcctggtcaccactgctgcttccatgcctgtggatattgtcaaaactaggatccaaaatatgcgaatgattgatgagaagccagagtacaagaatgggctggatgtattgctgaaagtcgtccgctatgagggtttcttcagcctgtggaagggcttcacaccatactatgcccgactgggcccccacactgtcctcaccttcatcttcttggaacagatgaacaaggcctacaagcgtctcttcctcagtggctgag

SEQ ID NO: 2116 - DNA, 1882 bp, Rattus norvegicus
  Genbank Accession No. NM_022399
cgggggccagtgtgccgccgccccctcggcccgccatgctcctttcggtgccgctcctgcttggcctcctcggcctggctgccgcagaccctgccatctatttcaaagagcagttcttggacggagatgcctggaccaaccgctgggtcgaatccaaacataagtctgattttggcaaattcgtcctcagttctggcaaattctacggggaccaggagaaggataaagggttgcagacaagccaagatgcccgattttacgcgctgtccgccagattcgaacccttcagcaacaagggccagacactggtggtacagttcaccgtgaagcatgagcagaatatcgactgtgggggcggctacgtgaagctgtttccgggtggcttggaccagaaggacatgcatggagactcagaatataacatcatgtttggtccggacatctgcggtcctggcaccaagaaggttcatgtcatctttaactacaagggcaagaacgtgctgatcaacaaggatatccggtgtaaggatgatgaattcacacatctatacacgctgattgtgcggccagacaacacctacgaggtgaaaattgacaacagccaggtggagtcgggctccttggaggatgattgggactttctgccgcccaagaagattaaggatcctgacgctgccaagccagaagactgggatgaacgagccaagattgatgaccccacagattccaagcctgaggactgggacaagccagagcacatccctgaccctgatgctaagaagcctgaggactgggacgaagagatggatggagagtgggaaccaccagtgattcaaaatcctgaatacaagggcgaatggaagccacgtcaaattgacaacccagattacaagggtacctggatacacccagagattgacaatcctgaatactcccccgatgcgaatatctatgcctatgatagttttgctgtactgggcttagacctctggcaggtcaagtctggcacaatttttgacaacttcctcatcaccaatgatgaggcctatgcagaggagtttggcaatgagacctggggtgtcaccaaggctgcagagaagcagatgaaggacaagcaggatgaggagcagaggcttaaggaagaagaagaagacaagaagcgtaaagaggaagaggaggccgaggataaagaggatgaggatgacagagatgaagatgaagatgaagaggatgagaaggaagaagatgaggaggatgccactggccaagccaaggatgagctgtagaggccacaccacctgcctccagggctggactgaggcctgaacacccgccacagagctggctgctccaataatgtctctatgagactcaagaacttttcattttttttccaggcaggttcaggtctggggtggattctgatttttgttccccctgcctcccccaatccctcccccaaccccccctttttttttactggtgtttgtctttaattcttcagccctcaacctcctggcctctcatttttgaatcaacattttttctttctgtccctttctccatctcttggtcactatcctccaactctaggaacaggtatggaggaaaagccctaggcttgagatttcatctgctctcctttctgaatctcagaggagggtaggagaagggggtggtatcttccctccccccagcactgaggaagaatggggctcttcccctttctcccttgcccccaggactgggccatttgtggggcagccagttctagcacagctcacactgagagtgtaagaactacaaacaaaatttctattaaattaagttttgtgtcttcaaaaaaaaaaaaaaaaaaaaaaaaaaaaaaaaaaaaaaaaaa

SEQ ID NO: 2117 - DNA, 1548 bp, Rattus norvegicus
  Genbank Accession No. NM_022400
cgggatcatgtctgcagctatactaggacaggtctggacccggaagcttctgcctattccctggcgtctatgtgtgcccggaagatgtgtgtcctccaacttcaaggcggcagacctccaggttcaggtgaccagagagccacagaagaagccagcccctagccagcctctgctgtttgggaagacattcacggaccacatgctgatggtggagtggaacagcaagacaggctggggccctccaaggatccagcccttccagaacctcacactgcacccagcctgctccggcctgcactactcattgcagctctttgaaggcttgaaagcttataaaggcagagacaagcaggtacgcctcttccggccctggctcaacatggacaggatgctacgttctgcaaggcgcctctgcctgccagactttgacaagcaggaactgctggagtgcatccgccagctcattgaagtagacaaagactgggttcccgatggcaatggaacaagcctctatgtgcggccggtgcttattggaaatgagccctccctgggtgttggaatggtcacacaagccctcctgttcgtcattctgtgccctgtgggctcctacttccccggagactccatgacacctgtctccctcctggcggacccctcattcgtcagagcctggattggtggggtcggtgactgcaagttgggggggaattacggccccactgtggctgtgcaacaagaagcccagaagaaaggctgcgagcaggtcctctggctgtacgggccggaccaccagctcaccgaggtgggaaccatgaacatctttgtctactggactcatgaagacggagaactggagctggcaacccccccactggatggcatcatcctccccggagtggttcgacaaagcctgctggatctggccaggacttggggtgagttccgggtggcagaacgcaaggtcactatgaaggaattgaagcgggcactggaggagggccgggtgcgagaagtcttcggctcaggcactgcttgtcaggtctgcccagtgcaccaaatcctatatgaaggcaagcaactccacattcctaccatggaaaatgggccggaactcatcctgcgcttccagaaggagttgaaggctattcagtacggaaccagtgcccacgattggatgcttcgtgtgtgacgttagggaggttgtgccctacctggttggatccgctgacgtgcagcatccagttcagcgtcctcgcctcccagagactcaagagaagtgcaatagggaaggtcgttccagactgctggctctctggcaccctcacgtggaagttacactccaaagccttaagggcggacccatgtaatttggaccccacctcagttcagctcgtccgcgtcctggtgttcaagagagaaccttggcttcttctcgatctccgttctcaggcggatccccggtgctcttcatgtctttttttttttttttttccgtctctctctccttgctgcaattttgaaataaaaatgccaaagaacaagaaaaaa

SEQ ID NO: 2118 - DNA, 2012 bp, Rattus norvegicus
  Genbank Accession No. NM_022407
acctgtgttccaggagccaaaccagcaatgtcttcccctgcacagcctgcagttcctgccccactggccaacttgaagattcaacacaccaagatcttcataaacaatgaatggcatgattcagtgagtggcaagaaatttcctgtccttaaccctgcaactgaggaggtcatctgccatgtggaagaaggggacaaggcagatgttgacaaagctgtgaaggccgcaagacaggctttccagattggctccccatggcgcaccatggatgcttcagagagaggacgcttgctgaacaagctggctgacttaatggagagagatcgtctgctgctggctacaatagaggccatcaatggtgggaaagtctttgccaatgcgtacttgtcggatttaggaggcagcataaaagcattaaagtactgtgcaggctgggctgacaagatccatggtcaaacaataccgagtgatggagacattttcacttttacgagacgtgaacctattggggtgtgtggccaaatcatcccttggaattttccactgcttatgttcatttggaagataggccctgccctcagctgtgggaacacagtggtcgtcaagccagcagagcaaactcctctcactgctcttcacatggcatctttaataaaagaggcagggtttcctcctggcgtggtgaacattgtccctggttatgggccaactgcgggggcagcgatctcctctcacatggatgtggacaaggtggccttcacgggatcaacccaggttggcaaattaatcaaggaagctgcaggaaaaagcaatctgaagagggtcacgctggagcttgggggaaagagcccttgcattgtgtttgcagatgccgacttggacattgctgtcgagtttgcacaccatggagtcttctaccatcaaggccaatgctgcgtcgcggcatcccggattttcgttgaggagtcagtttatgatgagtttgtgagaaagagtgttgagcgagccaagaaatatgtccttggaaatcctctgacccaaggaataaatcagggccctcagattgacaaggagcaacatgataaaatccttgatctcattgagagtgggaagaaagaaggagccaaactggagtgtggtggaggacgctgggggaacaaaggcttctttgtccagcccacagtcttctccaatgtgaccgatgagatgcgcattgccaaagaggagatatttggaccagtgcaacaaatcatgaagtttaagtccatagatgatgtgatcaagagagcaaacaatactacctatggtctagcagcaggagtcttcacaaaagacctggacagggccatcactgtgtcttctgctctgcaggccggggtagtgtgggttaactgctatatgatcttgtcagcccagtgccccttcggtggattcaagatgtctggaaatggacgagaactgggtgaacatggtctttatgagtacactgagctcaagacagttgcaatgaaaatatctcagaagaactcctaagaagcagagtgaagagaaactctcagctgtggctacacgtctcctatcgtcaccagcaaagtgttgttttactataattttttcttctgttgatttctttacatgatgaatccatcagtgttactgttactcatagaaaacatgtagcttaatcctacaaaaccactcaccttctaatatgtgactccagtccttatcccagaataaaaggatagatttaggtgcaagctctctgtaactctgtcatgataggtgctttctgtcgtagctccctgtctagagtactcatttggtgaggaggaccagtcgtgatttaagctctgtccctctgtgaccccttgaactgcttctcggcatgcatgataactgcagagtcggctgctctgtttcccaggtgttgtgaaatgttttctagaaagccatgcctgcttatcaaatgaaatgcccagctgtaattagaatgcaaagctaataaaggg

SEQ ID NO: 2119 - DNA, 552 bp, Rattus norvegicus
  Genbank Accession No. NM_022500
atgacctctcagattcgtcagaattattccaccgaagtggaagctgccgtgaaccgcctggtcaacttgcacctgcgggcctcttacacctacctctctctgggcttcttttttgatcgggatgacgtggctttggaaggcgtaggccacttcttccgcgaattggccgaggagaagcgcgagggcgccgagcgtctcctcaagttgcagaacgaacgcgggggccgtgcactcttccaggatgtgcagaagccatctcaagatgagtggggtaaaaccctggaggccatggaagctgccttggccctggagaagaacctgaaccaggccctcttggatctgcacgccctgggctctgcccgcacagaccctcacctctgtgacttcttggaaagccacttcctggataaggaggtgaagctcatcaagaagatgggcaaccacctgaccaacctccgtagggtgcagggcccacaaccagcgcagactggcgtggcccaggcatctctgggcgagtatctctttgagcgcctcactctgaagcacgactag

SEQ ID NO: 2120 - DNA, 364 bp, Rattus norvegicus
  Genbank Accession No. NM_022504
cggaaagctgcagccatggccctgcgctaccccatggccgtgggcctcaacaaaggccacaaagtgacgaaaaacgtcagcaagccgagacacagccgccgccgcgggcgcctcaccaagcacaccaagttcgtgcgagatatgatccgggaggtgtgcgcgttcgcgccctacgagcggcgtgccatggagctgctcaaggtgtccaaggacaagcgagcactcaagtttatcaagaagagggtgggcacgcacatccgcgccaagagaaagagggaggagctgagcaacgtgctggcagccatgcggaaggcggcggccaagaaggattgatgacccctcccccaataaaagatggttctta

SEQ ID NO: 2121 - DNA, 1269 bp, Rattus norvegicus
  Genbank Accession No. NM_022505
atgggctctaagtacccaaggtccctccgctgctgcctgcccctgtgggccttcgggctacaggtgacttttatcctcctcttctattttctcatcggccaagaccctatccaggcagatcacaagttcatggcgatctatcaagtcatccaggatttgacccttgtggcagccttgggtttcggcttcctgtcctcatcctttcggagacacggctggagcagtgtggccttcagcttcttcatgttggcccttggggtacaggggacaatcttgctggactatttcctgaattgggtcctcgactggaacatgatcaagaatccgttcagtccgtttctcagcatccagagagctaccataagcaccttaccgctgctgatctcagcgggcgctgtcttggggaaggtcaacttggtgcagctggccgtgatggtgctggtggaagctatgacctttggtgccatcagagtcgctgacaagaaggtcttcagaattgaagaccacataatcatgatgtacggacacgtgtttggggcctattttgggctgactgtggcatggtggctttccaagtctctgcccaggagaaggcatgagaacgcccagacagaaaaggttcagatgaccacgagctccagtctgtttgccatgctgggcaccctcttcttgtggatattctggccaagtatcaactctgctctcctggaagggacaaagaaaaagaacgcagtgttcaacacctactacgccctggcagtcagcacagtgacagccacctccatgtccgccctgagtcaccccaaagggaagatcaacatggttcacatccacaacgcagtgctggctgggggtgtggctgtcggtgccccgagttgcctgatttcttctccttggattgctatggtcctgggcctcacagctgggttgatctccatctggggagccaagtgtccacaggtgtgtttgagcgacttgctgctgaaccccagtgggatccactacaccttcggcttgcccggcctgctcggagcactcacctactactgcctccatataatagccgagtccaggccctccaatctctggattgtcacccaaacgatcactgacgtcggggctctcagctttgctatggcgatgggaatggtgactggactgctgacaggttgtctcctaagtgtcaaagtgtggagggctccccatgcagtcaagtactttgatgatcaggctttctgggagttcccccacttggctgtcgaattttaa

SEQ ID NO: 2122 - DNA, 1387 bp, Rattus norvegicus
  Genbank Accession No. NM_022510
cctgtgggagcagccgggtagagaggagcgtggccttctcctctccccgccatggcttgtgcccgtcccctcatatcggtgtactctgaaaagggggagtcatctggcaagaatgtcactttgccagctgtgttcaaagctcccattcgaccggatattgtgaactttgttcacaccaacttgaggaagaacaatagacagccctatgctgtcagtgaattagcaggtcatcagaccagtgctgagtcctggggtactggtagagctgtggctcgaattccaagagttcgaggtggtggcacccaccgttctggccagggtgcctttggaaacatgtgtcgtggaggccgcatgtttgcaccaaccaaaacctggcgtcgttggcatcgcagagtgaacacaactcagaaacgatatgccatctgttctgccctggctgcctcggccttaccagctttggtgatgtctaaaggtcactgtgttgaggaagttcctgaactgcctttggtggttgaagataaagttgaaagttataagaagaccaaggaggctgttcagctgcttaagaaacttaaagcttggaatgacatcaaaaaggtctatgcctcccagagaatgagagctggcaagggcaaaatgagaaaccgacggcggatccagcgcaggggaccctgcattatctataatgaagataatggaatcatcaaggccttcagaaacatccctggtattactctgcttaatgtaagcaagctgaacattttgaaacttgctcctggtgggcatgtggggcgtttctgcatttggactgaaagtgctttccggaagttggatgagttgtatggcacttggcgtaaggctgcttccctcaagagtaactacaacctccccatgcacaagatgatgaacacagaccttagcagaatcttgaaaagcccagagatccaaagagcccttcgagcaccacgcaagaagattcatcgcagagtcttgaagaagaatccactgaagaatctgaggatcatgttgaagctgaacccttacgcaaagactatgcgtaggaacaccattctccgccaggctaggaatcacaaacttcgagtgaaaaagctggaagccgcagctgctgcactggcagccaaatcggagaagattgttccagagaagggggctggagacaaaaaacctgcagtaggcaaaaaaggaaagaagcctgtggatgccaagaagctgaagaagcctgcagggaaaaaggtggttaccaagaaaccagcagagaagaaacctaccacagaagaaaaaaagtctgctgcataaactattaaaatttgttaaattccagagagcaaaaagatacagcctatttgaataaatcaaagatgcagtg

SEQ ID NO: 2123 - DNA, 689 bp, Rattus norvegicus
  Genbank Accession No. NM_022511
atggccgggtggaacgcctacatcgacagccttatggcggacgggacctgtcaggacgcggccatcgtaggctacaaggactcgccctccgtctgggccgctgtccccgggaagaccttcgttagcattacgccagctgaggttggtgtcctggtaggcaaagaccggtcaagttttttcgtgaatgggctgacacttgggggccagaaatgttctgtgatccgggactcactgctgcaagacggggaatttacaatggatcttcgtaccaagagcaccgggggagcccccaccttcaatgtcactgtcaccatgactgccaagacgctagtcctgctgatgggcaaagaaagtgtccacggtggtttgatcaacaagaaatgttatgaaatggcctctcacctgcggcgttcccagtactgacctcatctgtcccttcccccaccggtccctttggcttttgcacccccttctttccatacacacacacaccattattttttgggccattaccccatttcccttattggtgccaaaaccacatgggctgggggctggggctggatggacagacacctccccctacccataccccctcctgtgtgtgtttggggaaaaaatgtttttggggtttaattttgttttaatttttggtttgtttttttttttttttctgaataaaaaaagat

SEQ ID NO: 2124 - DNA, 463 bp, Rattus norvegicus
  Genbank Accession No. NM_022514
ctgctcgctgtcgaaatgggcaagtttatgaaacccgggaaagtggtgctggtcctggctggacgctactccggacgcaaagccgtcatcgtaaagaacattgatgatggcacctccgaccgcccttacagccatgccctggtggctggaattgaccgctatcccagaaaagtgacagctgccatgggcaagaagaagatcgccaagcgatccaagatcaagtcctttgtgaaagtttataactacaaccacctcatgcccacaaggtactctgtggatatccccttggacaaaactgttgtcaacaaggatgtgttcagagacccagcactgaaacgcaaggccaggcgggaggccaaggtcaagtttgaggagcgatacaagacagggaagaacaaatggtttttccagaagcttcgcttttagatgtatttttgttttcgtcattaaaaaaataaaaaat

SEQ ID NO: 2125 - DNA, 541 bp, Rattus norvegicus
  Genbank Accession No. NM_022515
ccggccagacatctgtcaccatgaaggtcgagctgtgcagttttagtgggtacaagatctacccgggacacgggcggcgctacgccaggaccgatgggaaggttttccagtttcttaatgccaaatgtgagtccgcattcctttccaaaaggaaccctcggcaaattaactggactgtcctctacagaagaaaacacaagaaaggacagtcggaagaaattcaaaagaaaagaacccgccgtgcagtcaagttccagcgggccatcacaggcgcttctctggctgatataatggccaagaggaatcagaaaccagaagttaggaaagctcagcgagaacaggctatcagggctgccaaggaagcaaaaaaggctaagcaggcatcaaagaagacagcaatggctgctgccaaggctcccacaaaggcagcccctaaacaaaagattgtgaagcctgtgaaggtctctgctcccagagttggtgggaaacgctaatttagtagatgagagtttaaaaataaagatttgtctctaaaaaaaaa

SEQ ID NO: 2126 - DNA, 2723 bp, Rattus norvegicus
  Genbank Accession No. NM_022516
cgtcccctgcggtctcctctgtgtgccatggacggcatcgtcccagacatagcagtcggtacaaagcggggatccgacgagctcttctccacgtgtgtcagcaacggccccttcatcatgagcagctcggcctcagcagccaacggaaatgatagcaagaagttcaaaggtgataacaggagcacaggagttccttccagagtcatccatgtccgaaagctacctagtgatgtcactgagggcgaggtcatctccctggggctgccctttgggaaagttaccaacctccttatgctgaaggggaagaaccaggccttcattgaaatgagcacagaggaggctgccaacactatggttaactactacacatcggtggcgccagtgcttcgtggacagcccatctacatccagttctccaaccacaaggagctcaaaaccgacagctcgcccaaccaggcacgtgcccaggcagccctgcaggctgtgaactccgtacagtcaggaaacctggccttggcagcctctgctgctgccgtggatgcaggaatggcaatggcaggccagagcccagtgctcaggatcattgtggagaaccttttctacccagtgacactggacgtgctgcaccagatcttctcgaagtttggcacagtcctgaagatcatcacgttcaccaagaacaaccagttccaggcgctgctgcagtatgctgaccctgtgagcgcccagcatgccaagctgtccctggatggccagaacatctacaatgcctgctgcacgctgcgcatcgacttctccaagctcaccagtctcaacgtcaaatacaacaacgacaagagccgagactacacacgccctgacctgccctctggagacagccagccatcactggatcagaccatggcagcagcctttggcctctctgttcctaatgtccatggagccctggcacccctggccataccctctgctgctgctgctgctgctgcagccggccgcattgccatcccagggctggcaggcgccgggaattccgtccttttggtcagcaacttgaaccctgagagagtcacaccccaaagcctctttattctcttcggcgtctacggtgatgtgcagcgggtgaagatcctgttcaacaagaaggagaacgcacttgtcgagatggcagacggcagccaggcccagctggccatgagccacctgaacgggcacaagctgcatgggaagtcagtgcgcatcaccctgtcaaagcaccagagtgtgcagctgcctcgtgagggacaggaggaccagggcctgaccaaggactatggcagctcaccgctgcaccgcttcaagaaacctggctccaagaactttcagaacatctttcctccctcagctaccctgcacctctccaacatcccgccctctgtgtcagaggatgacctcaagagcctcttctccagcaatggcggtgtggtcaaaggcttcaagttcttccagaaggaccgcaagatggcactgatccagatgggctctgtggaggaggcagtgcaggcactaattgagctgcacaaccatgacctgggcgagaaccaccacctgcgagtgtccttttccaagtccaccatctaggtgcctgtgggcctgcgaagcttccgccattccagaaaagccactttaaaaagcagctgaagtgaccttacagaccagagatttatttttttaaagagagatcagtttacctgtttttaaaaaaattaaatctagcccactttgccgtggcaggaaatggcttgggccacagaggcccaggcccagcaaccatgccttgaggggcttaggcgtgaggccacagcggtgccccaacacagccgcttctgtgccttacaaaaccagcgtgcctcacggccgcacacccaccctctaaggccaccagttgtctctagacctgcagtgagccaggcggcctatacttaggctccccaatgccgtgtaagagctggggccactcccctacacccattataatcaagtgacatgattctcccatgtccctggccagcccagagggcccaggccgtcctcagcgccgagccttgtgtgaccttgtattctattccgtggggtcacagacacctgtgcctagcaatctttccacttgaccaaatacccgagtcttttccatttatatgcaagagatagagtttttaagtaactttttatagcagtggtacaattgtatgtgtgtactctaagcttctctgtcccctgcactccttccttccagtgaccaacttgcaggtgggcccaggccagggctggagaagaagctctgaggcttgtgggtgtcctaccttcaaattttggaccaaagttttgttctctgcccgcctctgactatgcccagttgaggggctgacctctaggccttaatgtccttcctggacgcccacctccatcctagcctgtttctatgggaggggttccctgcacctcagtttctgtgaaagtcatggaagagtgtaaatatttatgattttatacctgtggggctgaggcggtgcagcattttttatggtgacagatgtatattttggtaacgactacaggctcagtattgtcctgggccagccctagccacatctaccccagcccagatggtgtattggggggagggggactttccattaaagcagtttataacctttgaaaaaaaaaaaaaaaaaaaaaaaaaa

SEQ ID NO: 2127 - DNA, 900 bp, Rattus norvegicus
  Genbank Accession No. NM_022518
gcggctgctaaggaccgagtctggtcgggcggcctgaggtctctggccagtatcgcttccacctgtccacaaacatggggaatatctttgcaaacctcttcaagggcctttttggcaaaaaagaaatgcgcattctcatggtgggcctggatgctgcagggaagacaacaattctatacaaactgaagctgggcgaaattgtgaccaccattcccaccattggtttcaacgtggagactgttgaatacaagaatatcagcttcaccgtgtgggatgtgggtggccaggacaagattcggccgctgtggcgccactacttccagaacacccaaggcttgatcttcgtagtggacagcaatgacagagagcgtgtgaacgaggcccgtgaagagcttatgaggatgctagctgaagatgagctccgagatgccgttctcttggtgtttgccaacaagcaggacctccccaatgccatgaatgcggccgaaatcacagacaagctggggctgcactctctacgccacaggaactggtacattcaggctacctgtgccaccagcggagacgggctctatgaaggactagattggctgtctaatcagctccggaaccagaagtgaaccagacccctccttccccctcacttcctcttctccgccctcagctttcctctcatgtggcaaacgtgcgactctgtggtcctgagtgccagaagctgtctccatgggttggtcacagtgtgcatcgcaccgtgctgtacatgtgcagacgcagcctgcagccaggtttttatttaatgtaaatagtttctgtttccactgaggcagtttctggtactcctatgcaatattacttagctttttttattgtaaaaagagaatcaactcactgtcagtacct

SEQ ID NO: 2128 - DNA, 1938 bp, Rattus norvegicus
  Genbank Accession No. NM_022521
gcggacgtgtcaggtctctctgcacttccattcctgaaggacccacacaatgctttccaaactagcaagtctgcagactgttgccgctctgcgtcgaggactccgcacctcagtcgcctctgccacatctgttgcaacgaagaagacagagcaaggcccaccatcctctgagtacatttttgaacgggaatctaaatatggtgcacacaattaccatcctttacctgtagccctggagagaggaaaaggcatttatatgtgggatgtggaaggcaggcagtacttcgacttcctgagtgcttatggtgctgtcagccaaggacactgccacccaaagatcatagaagccatgaagagtcaggtggacaagctgacattaacatctcgggctttctataacaatgtccttggtgaatatgaggagtacatcaccaagcttttcaactacaacaaagttcttcctatgaatacaggagtggaggccggagagactgcgtgtaagcttgctcgccgttggggctacaccgtgaaaggcatccagaaatacaaagcaaagatcgtttttgctgttggaaacttttggggtcggacgctgtctgcagtctccagttccacagatccgaccagttatgatggctttggacccttcatgccaggctttgaaaccatcccatataacgatctgcctgcgctagagcgtgctcttcaggatcccaatgttgctgctttcatggtggagcccatccagggtgaagcgggtgttatcgttccagatccaggatacctgacgggagttcgagaactttgcacccggcaccaggtcctgtttattgctgatgaaatacagacaggattggctagaactggtcgatggctagctgtggatcatgagaatgtcagacctgacatagttcttcttgggaaggccctttctggtggcttatatcccgtgtctgcagtgctgtgtgatgatgacataatgctgaccattaaaccaggcgagcacggctccacgtatggcggcaacccactaggctgccgaattgctattgcggctcttgaggttttagaagaagagcatcttgctgaaaacgcagacaagatgggtgccatcttgagaaaggagctcatgaagctgccatctgatgttgtgactgctgtgagagggaaagggttgctaaatgccatcgtcatccgagaaaccaaagattgtgacgcttggaaggtgtgcctgcgactccgagataatgggcttctggccaagccaacccatggtgatatcatccggcttgcccctccacttgtgatcaaagaggatgagatccgggagtcagtggagatcatcaacaagaccatcttgtccttctgagagtaggaactctggggagccatcttcagatggggctcttgtgaaactctgcttgggatgggcagattcggcttgtctgtctcctaaaagacaattttttgaatatgtattatatatttcagttgatgcatagtggagtgacacctaggaacctgcaggtggctgcgtgacacaagagtgagagcgagaggcatctctttgttaaagtttgactgtgtgggagctttctaaggagaaacagatctatctgcatacagcctgcagagtcctgccgtaatttacatgtgtctttacatcttccttgctggcatgaatgttttgtatttggaagtttttttctgagatactacataagaaactgttgaatcattataatcaatgaatggtaagatgattgagggttgagcatatgtaaaatactagtttaaagtacactttgcattggccaacagcagaatgtattatatagtttctgagaattcattaccaaattatactttaagtgcttgattgcaatttgtaaaacatttattttcagtatttctttgaataaagcttcgtttttcttt

SEQ ID NO: 2129 - DNA, 1668 bp, Rattus norvegicus
  Genbank Accession No. NM_022523
gcgctcctacagtggctgccggggctggtatttcaaagcgtggttgatctggtggctctgagaatcattctgattactgcttcagacaccataggagtggcaagatcccacctgccaggtgaagggcgggcagatcagtgactttgacctgtacctgctggtcctgacttccagaggcccaggatgggggaattcaacgagaagaaggcaacatgtggcacagtctgcctcaagtatctgctgttcacctacaactgctgcttctggctggctggcctggccgtcatggcagtgggcatttggacactggccctcaagagtgactacattagtctgctggcttcaagcacctacctagcaacagcctacatcttagtggtggctggtgttgttgtcatggtgactggagtcctgggctgctgtgccactttcaaggagcgacggaacctgttacgcttgtacttcatcctgctcctcatcatcttccttctggagatcattgctggcatcctggcctatgtctactatcagcagctcaacaccgagctcaaggagaatctgaaggacaccatgatcaagagataccaccagtcaggccatgagggtgtgaccaacgctgtagacaagctgcagcaagagttccactgctgtggcagcaacaactctcgagactggagagacagcgagtggatccgctctggtgaggcagacagccgtgtggtccctgacagctgctgtaagactgtggtaactggctgtggtaagcgggagcacgcctccaacatctataaagtggaaggtggctgcatcactaagctggagtccttcattcaggagcacctgcgggtcatcggggccgtgggcattggcatcgcctgtgtgcaggtcttcggcatgatcttcacctgctgcttgtacagaagcctcaagctggagcactactgaccatggtgccaggccagaaggccagcctcgcgctgtgtcccagccccccactactgaacactactgagttagactgctgactgccagagaggtagctgccctcatgccattaccatgtcccctggtggctccacctccgtggtagcttcaagtgcctttccctgcacaccaaagtcccaaagcttgaggcagcgtacttgccccagcattaacaagagggggcatgtatgccagtgttgggctaggcctggctagtagagtagggtttagattacttgacagaagtgcctcttatgtagactgcttccctttgggtagctgtgatctgcagtaagtctggggagaatccgagcataccactacacggtgggtaagagcaggtgggaaggggcctttctggttgggctaggcacctttcatgcctgctgccaggaaccctcagatagggcaagcttaggggaactggaatcccacactgtatgctgtcctttccacacaggcctcttgctcctaacggcctcagccctgggcttttcctactactgataacactatgtaaatgttccatgttcctgtacactgtctcttttgggaacatctctgaatggagcatggctgttttcattcactgctgtatcccagatgcccacagatgctcctgctgtgtgacaggtgctcaataaatgtataagcagtcaaaaaaaaaaaaaaaaaaaaaaaaaa

SEQ ID NO: 2130 - DNA, 1827 bp, Rattus norvegicus
  Genbank Accession No. NM_022524
atcttggcctcctccagccccttagtgctgcgcagcctgcccggcgggggaagcgccggctcgccatggggagcccgggactccggcccacgctgctgctgcctcaagtactgttgctgttgctggcgctgctgcacgtcccgccgagccagggcttcccaggctctggagactcaccactagaagacgatggagtctggtcttcacactctctctataaagacactccgtggtgctctcccatcaaggtgaaatatggggatgtgtactgcagggctcctcctgggggatattacaaaacagccctggggaccaggtgtgacattcgctgcaggaagggctacgagcttcatggctcttcccagctcgtctgccagtcaaacaggcgctggtcggataaggtcatctgcaaacaaaagcgatgtcctaccctcaccatgccagcaaatggagggtttaagtgtgtcgatggcgcctactttaactctcggtgtgagtactattgctcaccaggatatacattgaaaggggaacggacagtcacatgtatggacaacaaggcctggagtggccgaccagcctcctgtgtagatatggaacctcctagaatcaagtgcccaagtgtgaaagaacggatagctgagcctaataagctgacagtccgcgtgtcctgggaaaccccagagggaagagatacagcagatgggattcttactgatgttattctgagaggtcttcctccaggctcgaattttccagaaggagaccacaagattgagtacactgtctatgacagagccgagaacaagggaacttgcaagttccgagttaaagtaagagtcagacgttgtggcaagctcaatgccccagagaatggttacatgaagtgttccagcgatggtgacaattatggggccacctgtgagttctcctgtatcggtggctatgagcttcagggtagtcctgcccgagtatgccaatccaatctggcttggtctggtacagagcctagctgtgcagcgatgaatgtcaatgttggtgtcagaaccgcagctgcacttttggatcagttttatgagaaaagacgactcctcattgtgtctacacccacagctcgaaacctcctctacagactgcagctgggaatgctacagcaagcacagtgtggtctggatctccgacatatcaccgtggtggagctggtcggagtcttcccaaccctcatcggcaggatcagagcaaagattatgcccccagccctagctctgcagctcaggttgttgcttcgaatcccactctactccttcagcatggttttagtggataagcatggcatggataaagaacgttatgtctccttagtgacacccatggctctcttcaacctcattgacactttccccctgagaaaagaagagatgatccttcaggctgagatgggccagtcttgcaacacctgatgtgctgttccatttcctggtgctttctcacctcttatcatagagtatatcatgtagtatactacagtgcctgtgggaaggccttaaaaatacctttgatgtacagattttcatttgtaatttttaaagtctattttattatgtgcttcctttgctcttaaacattggcacaatgccttttaaactttgaaatgttaaaaaaaaagtacgaatatatctattctaactctccctttaggccattgtggctgatgaaattagaagtgacagccacgcccatgctttcagaatattattcagtgtgaaacacattttccttttctcttattgtttatataagtcttttgttaataaaatattttgaagc

SEQ ID NO: 2131 - DNA, 1034 bp, Rattus norvegicus
  Genbank Accession No. NM_022525
cagatgggtgcgagagatgccagtggaacgagtgagaagaaggactgtcctccagagagggggatgtgtccctgcctgggagcctaagcctgaatgcactaagggccaccccaaagacgcgccccagcccgccatgtcccggatccttcgggcatcctgcctcctgtccctgctcctggccgggtttgttccgccgggccggggacaagagaagtccaagacagactgccatggcggtatgagcggtaccatctacgagtatggagcccttaccatcgatggggaggaatacattccttttaagcagtatgctggcaaatacatcctctttgtcaacgtagccagctactgaggtctgacagaccaataccttgaactgaatgcactacaagaagaacttggcccattcggcctggtcattctgggcttcccttgcaaccaatttggcaaacaggagccaggcgagaactcggagatcctgcctagtctcaagtacgttcgaccgggtgggggctttgtgcctaatttccagctctttgagaaaggagacgtgaacggggagaaagagcagaagttctacactttcctgaagaactcctgccctcccactgcggaactcctgggctcacctggccgcctcttttgggaacccatgaagatccatgacatccgctggaactttgagaagttcctggtggggccagatggcataccaattatgcgctggtaccaccggaccacagtcagcaacgtgaagatggacatcctgtcctatatgaggcggcaggcagccctgggggccagagggaagtaactgatgccctaccccaccccaccccatcccctgcccatcatgcaagggctggggaggggctcttcaggaaggaagcaaaaaacggaatcattctacacatacatcccagattcccttccttattacataaaagacaagcttggcacactgtgtgcctgtaccactgtgcacatcgtggcaactgtcccactgtgtgccatgcactgcctgcctggaaccc

SEQ ID NO: 2132 - DNA, 2169 bp, Rattus norvegicus
  Genbank Accession No. NM_022531
cctcttatccactctccagccggctgcccgcctgctgcctcctctttgcgtccgctcagcctcgtccacgccgccaccatgagccaggcctactcgtccagccagcgcgtgtcctcctaccgccgcaccttcggcggcgccccgggcttctcgctcggttccccgctgagctctccggtgttcccacgagcaggcttcggtaccaagggctcctcgagctcagtgacatcccgcgtgtaccaggtgtcgcgcacgtcgggcggggccggaggcttggggtcgctgcgggctagccggctggggaccacccgagcaccatcctatggcgcgggcgagctgctggacttctcgctggccgacgcagtgaaccaggagttcctggccacgcgcaccaacgagaaggtggagctgcaagagctcaatgaccgcttcgccaactacttcgagaaggtgcgctttttggaacagcagaacgccgcgctcgccgccgaggtcaaccggctcaagggccgagagccgactcgggtcgccgagctctacgaggaggagatgcgagagctgcggcgccaagtggaggtcctcaccaaccagcgcgcccgcgtcgacgtggagcgtgacaacctgatagacgacctgcagaggctcaaggccaagctacaggaggaaatccaactgagagaagaagcagagaacaacttggctgccttccgagcggatgtggatgcagccactctggctcgaattgacctagagcgcagaattgagtcactcaacgaggagattgcattccttaagaaagtgcacgaagaggagatccgtgagctccaggcccagcttcaggaacagcaggtccaggtagagatggacatgtccaagccagacctcacagccgccctcagggacatccgtgctcagtatgagaccattgcggctaagaacatctctgaggctgaagaatggtacaagtccaaggtttcagacttgactcaggcagccaataagaacaacgatgcgctgcgccaagccaagcaggagatgatggaataccgacaccagatccagtcctacacctgcgagattgatgctctcaagggcaccaacgactccttgatgaggcagatgagggagctggaggatcgcttcgccagcgaggccagtggctatcaggacaacatcgcgcgcctggaggaggagatccgacacctaaaggatgagatggcccgccatctgcgggagtaccaggatctgctcaatgtgaagatggccttggatgtggagattgccacctaccggaagctgctggagggcgaggagagcaggatcaaccttccgatccagaccttctctgctctcaacttccgagaaaccagccctgagcaaaggggttccgaagtccacaccaaaaagacagtgatgatcaagaccattgagacccgggatggagaggtcgtcagcgaggccacacagcaacaacatgaagtgctgtaagccagacacgtgtcctggccccgtcctcactgcctcctgaagccagccttttccactctcggatgtcacacccagtcgcttttctcctctcacagcctctgaaccctcctcacaatcacctctttgtggtcttcatgctgcccagcctcaggaaacccctcagccacctctgcagaccctcccatgagccctggctattggcaactgtcaagcctggctcttaagagagaacctagctcaaggcctgacccttttccctgccatctttgtgacctctggcttagaagggggtaccagagagggcgatgggaccggcagggtcaggacagagctttgtggatatccccacattcgacccccagcctgggtcagagacagaatgaagcctcagcgagctgagatggagaagggggggcctgaaaaatgtcctcgtggcccctctctttcccaccccagctcagataggcttggaaagcaggggctgtaagagagaactggaaggtgctggatgtgggagcaggagatacagaaggagagaggatgggtgagaagttggagaggaaagaagagagaggcagagagtgggctcaggttggtgggaggatgccacctcccctgcctgcccctcccaccgcaggggccctggacagaaacaataaagagataagcacaaaaaaaaaa

SEQ ID NO: 2133 - DNA, 2288 bp, Rattus norvegicus
  Genbank Accession No. NM_022532
gcggtagcgtgtgacaggaggcctatggcacctgcccagtcctacctcagcccatcttgaaaaaatccttagacaacatggaaccaccacgaggccctcctgctagtggggctgagccatctcgggcagttggcactgtcaaagtgtacctgcctaacaagcaacgcacagtggtgactgtccgggatggcatgagtgtctatgactctttggacaaggccctcaaggtgcggggtctcaatcaggactgctgtgtggtctacagactcatcaaaggaagaaagacagtcactgcctgggacacagccattgcacctctggatggcgaggagctcattgtggaggtcctggaagatgtgccactgaccatgcacaattttgtacggaagacattcttcagtttggccttctgtgacttctgccttaagtttctgttccacggctttcgctgccaaacctgtggctacaagttccaccagcattgttcctccaaggtccccacggtctgcgttgacatgagtaccaaccgccgacagttctaccacagcatccaggatttgtctggaggctccaggcagcaggaggttccctcaaatctctctgtgaatgagctgctaaccccccagggtcccagtccctttacccagcaacgtgaccaggagcacttctccttccctgcccctgccaatcccccactgcagcgcatccgctccacatctactcctaacgtccacatggtcagcaccacagctcccatggactccagcctcatgcagtttactgctcagagcttcagcaccgatgctgctggtagaggtggtgatggagctcctcggggtagccctagcccagctagtgtgtcttcagggaggaagtccccacattccaagttacctgcagaacagcgggaacggaagtccttggcagatgaaaagaaaaaagtgaagaacctggggtaccgggactcaggctattactgggaggtgccacccagtgaggtacagctgttgaagaggatcgggacaggctcttttggcactgtgtttcgggggcgttggcatggcgatgtagctgtgaaagtgctcaaggtggcccaacctaccgctgagcaggcccaggccttcaagaatgagatgcaggtgctcaggaagacacgacatgtcaacattttgctgtttatgggtttcatgactcggccagggtttgccatcatcacacagtggtgtgagggttccagcctctaccaccacctacatgtggctgacacgcgctttgacatggtccagctcattgatgtggcccggcagactgcccagggcatggactacctccacgccaagaacatcattcaccgagacctaaagtccaacaatatcttcctacatgaggggctcacagtcaagattggtgacttcggcctggccacagtgaagacacgatggagtggggcccagcccttagagcagccctcagggtctgtgctgtggatggcagctgaggtgatccgaatgcaggacccgaacccctacagcttccagtcggatgtctatgcctatggtgttgtgctctatgagcttatgaccggctcactgccctacagccacattggcagccgtgaccagatcatctttatggtgggtcgtggctatctgtctccggacctcagcaaaatcttcagtaattgccccaaagccatgaggcgcttgctgactgactgcctcaagttccagcgggaggagcggcctctatttccccagattctggccacgatcgagctgctgcagcggtcactccccaagattgagcggagtgcctccgaaccctccttgcaccgtacccaggctgatgagttgcctgcctgccttctcagcgcagcccgccttgtgccttagactccactcccagcccactagggagccattttcagcttaccatgccaaggcacccccttcctaccagccaatcattgttctgtctgtgccctgatactgcctcaggattccctatcccacaccctgggaaatttgggggactccaaaaactgaggtcccctgcttcctccataatttggtctcctcttggctttggggatagttctaatttggagagctgttttacctccaatggctgggattcagtgcaaagattccactcggaacctctttataaagttttcgcctgacatgtcttcactgaattatggggttcccagcaccccatgcggatttgggagtttccctttgtctccccccactattcaaggactctcctctttaccaagaagcaca

SEQ ID NO: 2134 - DNA, 1808 bp, Rattus norvegicus
  Genbank Accession No. NM_022534
caagccctcaaggcgggttccaggagtctctcacctcccacctgtgcctgccatggagctcctgaaggcgctgctactcctgtctggagtcctcggggctcttgctgaattctgtgtaataccaaagatggacggccagctggtagagaagctgggccagcgtctcttaccttggatggatcggctttcctcagagcagttgaaccccagcatctacgtcggcctgcggctttccagcatgcaggctgggaccaaggagaacctctaccttcacaacctcaaactccattaccagcagtgcctcctgcggtccacctcgagtgatgataacagtggttgccagactaagatttctgggggcagcttggccctctacctgcttgctctcagggccaactgtgagctcctggggagccgaaagggtgacaggatggtctcacagctcaagtggttcttggaggatgagaagaaggccattgggcaccatcatgaaggccacccccacaccagctattaccagtatggcctcagtatcctggccctgtgcgtccaccggaagcgggtccatgacagtgtggtgggcaagctcctgtatgctgttgaacatgactactttacctaccagggccacctctctgtggacacagaagccatggccggcttggccttcacctgtttggaacgattcaatttcaactctgacctgagaccacggatcaccacggccatcgagacagtgcgagagaagatcctgaaggcccaggcccctgagggctactttggaaatatctatagcactccgctggcactacagatgctaatgacctctcctggggtagggctgggcccagcttgcctcaaggcaaggaaatccctgctgctcagcctacaggatggagccttccagaatcctatgatgatttcccagctgctacccgtcctgaaccacaagacctacttgaatcttatctccccagactgccaggcacccagggtcatgttggtgcccgccactgaggaccctgtccacttgtcagaagtcagcgtcacgctgaaggtctccagtgtcttgccaccatatgaacgaacagtttccgtctttgctggggcctccttggaagatgtcctgaacagggcgcgagaccttggagaattcacgtatgggacccaggcctccttgtcaggtccctacctgacatccgtactagggaaagaagctggggatcgagaatactggcagcttctccgagtccctgatacccctctgctacaaggcattgctgactacaaacccaagaacggggaaaccatcgaattgcggctagttaagatgtagccctaggctccctcctgatgtcttcggaccctgctgccacctcaagtgcgcttggaacaatgtcccccagatcacctcagctaacttcccaaagaggacctaagccactgtccaccttagagcaggaaggaaaacacctcctcccttagggaggctgctagcttgagtgtggccctgcctgactccacaggtctttcatgaagattgccccataagtctgaggaacaggatgccctcaactccctctacataaaggagtctgttggccatgggtgttgtgagtaccattgctctgggactggggtcctacaagaaggacctccatggcccaagtgctgtggttctgacccacacaccctacccctgctctctctcaggatggtggtcccaaagctggtcgtgaagcagcctttggccctcaacagggtcttccaacacaattaaagccttgatttacctaaaaaaaaaaaaa

SEQ ID NO: 2135 - DNA, 840 bp, Rattus norvegicus
  Genbank Accession No. NM_022536
gctgcgcctctcggagcgcaatatgaaggtgctcttcgccgccgccctcatcgtgggctccgttgtcttccttttgctgcctggaccctccgtggccaacgataagaagaagggacctaaagtcacagtcaaggtatactttgatttccaaattggagacgaacctgtaggacgagtgacctttggactctttggaaagactgttccaaaaacagtggataattttgtagccttagctacaggagagaaaggatttggctataagaacagcaagttccatcgtgtcatcaaggacttcatgatccagggtggagacttcaccaggggagatggcacaggaggaaagagcatctatggtgagcgcttcccagatgagaacttcaagctgaagcactatgggcccggatgggtgagcatggccaatgcaggcaaagacaccaatggctcccagttcttcataactacagtcaagacctcctggctagacggcaagcacgtggttttcggcaaagttctggaaggcatggatgtggtacggaaggtggagaacaccaagacggacagccgggacaagcccctgaaggatgtgatcattgtagactgtggcaagatcgaagtggagaaaccctttgccattgccaaggagtagagagagcctcggggacctcatccctctaaacagctgtctgtgcgggtcctgtcgattccctcacaggtgaaagcagccagtcacaaggctctgtgcggctctggctccagtgcttccatccgacggggtggccacacccctcacattccacaggcctgatttttatataaaactcctaccaatgctgatat

SEQ ID NO: 2136 - DNA, 871 bp, Rattus norvegicus
  Genbank Accession No. NM_022538
agatctgtgaccatgttcgacaagccgcggctgccgtacgtggtcctcgatgtgatttgcgtgttgctggctggattgccttttataattcttacttcaaggcatacccccttccaacgaggagtgttctgtactgatgagtccatcaagtacccttacagagaagacaccatcccttatgcgttattaggtggaatagtcattccattctgtattatcgttatgattactggagaaactctgtctgtttactttaatgtcttgcattcaaattcctttgtcagcaatcactatatagccaccatttacaaagccgttggagcctttttgtttggagcctcagccagtcagtccctgactgacattgctaagtactctataggcagactgcggcctcacttcctggctgtctgtaacccagactggtcaaaaatcaactgcagcgatggctacattgagaacttcgtatgtcaagggaatgaacagaaggtcagggaaggcaggttgtccttctactcggggcactcctcattctctatgtactgcatgctgtttgtcgcactttatcttcaagccaggatgaagggagattgggcaagactcttacgacccatgctacagtttgggcttgttgctttatccatatatgtgggcctgtctcgagtttctgattacaaacaccactggagcgacgtgttaattggcctcattcaaggagctgttgtggcaatattagtggttttgtatgtaactgatttcttcaagaccacagagtctaacaaagaaagaaaagaggactcacatacgactctacacgaaaccaccaacagacagagctacgcaaggaatcacgagccctgaaggggtcgac

SEQ ID NO: 2137 - DNA, 1433 bp, Rattus norvegicus
  Genbank Accession No. NM_022540
gctatcgtggctcttgcgttctctgaagatggcggcagctgcgggaaggttgctctggtcctcggtggctcggcctgcgagcactattttccggagtatttctgcctcaacagttcttaggcctgttgcttctagaagaacctgcttgacagacatgctgtggtctgcctgtccccaagcaaagtttgcctttagcaccagttcttcattccacacccctgctgtcacccagcatgcgccccattttaaaggtactgctgttgtcaatggagagttcaaagagctgagtctcgacgactttaaggggaaatacttggtgcttttcttctaccctttggatttcacatttgtgtgtcctacagaaattgttgctttcagtgacaaagccaatgagtttcatgacgtaaactgtgaagtagttgcggtttctgtggattcccacttcagtcatcttgcctggatcaacacgccaagaaagaatggtggtttgggccacatgaacatcacgctgttgtcggacttaactaagcagatatcccgagactacggagtactgttggaaagtgctggcattgcgctcagaggtctcttcattattgaccctaatggtgtcatcaagcacctgagtgtcaatgaccttccggtgggccgaagtgtggaagaaccactccgtttggtaaaggcgttccagtttgtggagacccatggagaagtctgcccacccaactggacaccagagtcccctacgatcaagccaagtccaacagcttcaaaagagtactttgagaaggtccatcaataataggtcatcctatgtctgctggtttacctgaagcttctcatgccaaaagagagccccagctggaatcctgaagattatttatagaatggcaaaaacctcaccatgcttgtgtttataagtactgctccatgggctttgtaattttaagacaggttcaggttaaaggtggccagctccttccatagctgtccttactagggacttcttgatggctaccaattctctacaagtgcttggtccccatttcttagatcatgtcttcagagggttaagatttcttagcctgccctgaagcttggtctacagtgaagtagcacatagcaccagtacttagtgaaatgaagtagcacatagcgccagcacttagtgaaatgaagtagcatatagtgccagcacttagtgaaagcttctgatcaaggtcctgaaatttcctcttggatttttgttaattatgctgaatttcccattattttttagtgtagtcattaactcacagtgtccttgtgtgttctaaggtattgatgagttataatcatgaaggactatgtttctaaaacactatgtcattttcttttcttcaagtgctggatgtaaagaataaaaataaacattaagataaaaaaaaaaaaaa

SEQ ID NO: 2138 - DNA, 2183 bp, Rattus norvegicus
  Genbank Accession No. NM_022542
gttcgcaaaatcagccatcgactcgcacaaagcagcgcactccgggacagccgagaacactacccggcagcagcgcggcgacactccgtgcatcgtatgcccctgcgcccctgccgcggcagccggagcgccccgagagaacgctccaccgcggggtccaggtgcagttagcgtgcctagcccgcatcgcgcggtcgcgggagagcgggaagcggcaagcagggagcgggacggcggcgaggcgctcgcgggcccctcctgctgcccgcgcccggcgagctcatggcggccatccgcaagaagctggtggtggtgggcgacggcgcgtgcggcaagacgtgcctgctgatcgtgttcagtaaggacgagttccccgaagtgtacgtgcccaccgtgttcgagaactatgtggcggacatcgaggtggacggcaagcaggtggagctggcgctgtgggacacggcgggccaggaggactacgatcgtttacggccgctctcctacccggacaccgacgtcatccttatgtgcttctcggtagacagcccggactctctcgagaacatccccgagaagtgggtgcccgaggtaaagcacttctgccccaatgtgcccatcatcttggtggccaacaaaaaagacctgcgcagcgatgagcatgtccgcacggagctggcccgcatgaagcaggagccagtgcgcacggatgacggccgcgccatggcggtgcgcatccaagcctatgactacctcgagtgctcggccaagaccaaggagggcgtgcgcgaggttttcgagacggccacgcgcgccgcgctgcagaagcgctacggatcccagaatggctgcatcaactgctgcaaggtgctatgaaggccgcgccctgcctcacgcccttgccagcgtggctccccctccttggcccggtcgcccactaaccgggagaaagggagacccgtgcccccgaggacaccaccagactgcctgacatctgctggtggctctggctggtcacgctgaatattagcgtgggcaccgagctccccccttcccagtgtctgtgtgtgtccagctgtgtggcacaggcctgggcgccctgctgagtgccaaggggttcctgagcgtccttttctaaagagccaggcctcgaagtgtggttgtgtgtgtgtacgactccctacacccctaccccactcctgccccacccccgcctctggtttccccaggggcatgcagagtggttgagccccagcagatgtacgcttgtaaccagcaagccactactgttgctccatgtctgtaacatagaccccctggaatcacgggaggggagggctggggaggatggggatgttacataaatacagattttattttcggaggcagaatggtattgtttagtggtgagtggtgtgaccagggcccatgagcaactcttcccaggctgggtcaggagcccacccatccaagcatgaactggactcggccatctttccacaccctggggaagacatttgcaactgacttgaggttgagaggaagcagctcccagacacagtgtctcctgggccaagccccagcgaacctcctttccagccacctgcagaggatccagggtgtgctgtggggtcacttttgccataagcgaactttgtgcctgtcctacaagtgaacattgttcagtccgagagactattgttgctgaatttatttaaaggctgaagctttttttgttgttgatgaaagaattctttgcacaattgtcccattgtttgacacccagtgcacttgtcatttgcataaggcagcattttgaccacacttgtatgctgtaacctcatctacttctgatgtttttttttttaaacaaactatgatgactttaaggagattacaaaaaagattctaatttttgctttgttttcttgaaaaaaatgtcaaccatgtgactttttaaaaatttgtgtagcatacacacagttttggtaaaggaaggcaacacgtattggggtctatttaaacctccctccctctccccacaagacaagtctcttcatctatgtgaaattttctgtacattctctgtgcagagcaaagcttcttcttccttattcccctccttcccagcccagtggtacttctactaaattgtctattgtcttgttttgtttttgttttatttt

SEQ ID NO: 2139 - DNA, 1514 bp, Rattus norvegicus
  Genbank Accession No. NM_022546
tgaacccgcaggtttgcaccggaggctctcgcgggggcctcgctggccctgggcggggactcgcgggctgaggacgctcctgtgtccccagaatcctgcagaaggacagcgccatgtccacgttcaggcaggaggacgttgaggaccattatgagatgggagaggagcttggcagcggccagttcgccatcgtgcgcaagtgccagcagaagggcaccggcatggagtacgcggccaagttcataaagaagcggcgcctgccgtccagccggcgcggtgtgagccgtgaggagatcgagcgcgaggtgagcatcctgcgcgagatccgccaccccaacatcatcacgctgcacgatgtgttcgagaacaagacagatgtggtgctgatcttggagctggtgtccggcggcgaacttttcgactttctggctgagaaggagtcactgacagaggatgaggccacgcagttcctcaagcagatcctggacggtgtccactacctgcactccaagcgcatcgcgcactttgacctgaagccggagaacatcatgttgctggacaagcatgcagccagcccacgcattaagctcatcgactttggcatcgcgcacaggatcgaggccggtagcgagttcaagaacatctttggcacgccagagttcgtcgcccctgagattgtaaactatgaaccacttggcttggaagctgatatgtggagcatcggcgtcatcacctacatcctcctgagcggggcttccccattcctgggggagaccaagcaggaaacgctgacaaacatctcggctgtgaactatgactttgatgaagagtacttcagcagcaccagtgaactggccaaggacttcatccgaaggctgctggtcaaagatcccaagaggaggatgaccatcgcacagagcctggagcattcctggatcaaggttcgccggcgtgaggacggcgcccggaagccagagcgacgccgactgcgcgcggcgcgcctgcgcgagtacagtctcaagtcgcactcaagcatgccgcgaaacacgagctacgccagcttcgagcgcttctcgcgcgtgctggaggacgtggcggcggcggagcaggggctgcgcgagctgcagcggggccggcggcagtgccgggagcgcgtgtgcgcgctgcgcgtggctgcggaacagcgggaggcgcgctgccgcgacgggagcgccgggctaggccgcgacctgcgacgcctgcgcacggagctgggtcgcaccgaggctctgcgcacgcgcgcgcaggaggaggcacgggcagcgctcttgggcgctggtggcctgaaacgtcgcctgtgtcgccttgagaaccgctacgacgcgctagccgcacaggtggctgctgaggtgcagttcgtgcgcgatctggtacgcgcgctggagcaggagcggctgcaggccgagtgcggcgtgcgctaggctgcgacacccccagatctccggccatccccagaataaagctactttccacgc

SEQ ID NO: 2140 - DNA, 1999 bp, Rattus norvegicus
  Genbank Accession No. NM_022584
agccctaaccgcctaagtccccgggccatggcggcgattgtggcggcgctgcgcggatccagcgggcgcttccggccgcagacacgggttttaacacgcgggacgcggggcgcggcgggcgcggcgagcgcagcgggagggcagcagaacttcgatctcttggtgatcggtgggggatccggtggcctagcttgtgccaaggaagcggctcagctgggaaggaaggtggctgtggctgactatgtggaaccctctccccgaggcaccaaatggggccttggtggcacctgtgtcaacgtgggctgcatacccaagaagctgatgcatcaggccgcactgctggggggcatgatcagagatgctcagcactacggctgggaggtggcccagcctgtccagcacaactggaaggcaatggccgaagccgtgcaaaaccatgtgaagtccttgaactggggtcatcgtgtccaactgcaggacaggaaagtcaagtactttaacatcaaagccagctttgtcaacgagcacacagttcacggtgtcgacaaagccgggaaggtgactcagctttcagccaagcacatagtcatcgctacaggaggacggccgaagtaccccacacaggtcaaaggagccctggaacacggaatcacaagtgatgacatcttctggctgaaggagtcccctgggaaaacgttggtggttggagccagttatgtggccctggagtgtgccggcttcctcactggtattggcctggataccacggtcatgatgcgcagcgtgcccctccgaggctttgaccagcaaatggcgtctttggtcacagagcacatggagtctcatggcacccggttcctgaaaggctgtgtcccctccctcatcagaaaactcccgactaaccaactgcaggtcacttgggaggatctcgcttctggcaaggaggacgtgggcacctttgacactgtcctgtgggccatagggcgagttccagagaccagaaatttgaatctggagaaggctggcgttaataccaaccctaagaatcagaagatcattgtggatgcccaggaggccacctctgtcccccacatctatgccattggagatgttgctgaggggcggcctgagctgacacccacagctatcaaggcaggaaagcttctggctcagcggctctttgggaaatcctcaaccttaatgaattacagcaacgtccccacaactgtctttacaccactggagtatggctgtgtgggactgtctgaggaggaggctgtggctctccacggccaggagcatatagaggtttaccatgcatattacaagcccctagagttcacagtggcagatcgggatgcatcacagtgctacataaagatggtatgcatgagggagcccccacaactggtactgggcctgcacttccttggccccaacgctggagaagtcacacaaggatttgctcttgggatccagtgtggggcttcatacgcacaggtgatgcagacagtagggatccaccccacctgctctgaggaggtggttaagctgcacatctccaagcgctctggcctggatcctactgtgaccggctgctgaggttaagttaccatccctgctgagctaaggatacacactgtgcctgccatgtgcccagtacaaggctctcagacacctggacctagctattgtcatgggagccactgtgccagcatgattccaggcacatggtgaagctacctagaacaggactggaaggccttgctgcctcgcagagatctgagaagatgtggatggagcattgtgtatctgaatagatggtgtgtgtcctgcagggatgactgccccctctaacctctggccagccttcacacactgccagtgtcagatgatgacggcctgtgcagaaacccccacgtgggctgccaggtttgaacccctggcatttctggagtgctaataaagagcgtgttttagtaaaaaaaaaaaaaaaaaa

SEQ ID NO: 2141 - DNA, 4269 bp, Rattus norvegicus
  Genbank Accession No. NM_022585
tctcggccgcggtgtttccgtttctctccctggttgtcgcctgctctgctcttctcatccttctcgctctgctgctctgcggagtgacgaggctgaatcttctccccacccagttcgcgcttttcttctttttctcgcgccgctccatttctccagtccggctgccgccgccactgctgctcagctggtgtcggtgccgcgcgtttcccccacgtcgtccccgcagcctatggcccaggccgccttgggtatttctgctcaaggtaaccacatccctctttaaaaattccgccgaaaaagagaagacgctttacccgactctttgggccgttatctcacggcgaactttctgaccgagtatacaactacccagaaggcctaggagaagtgctgtatagagagcagttcgattttaacgctgagccaccttgggaacctagctgatgataggggggttccatctcctaacttgtccatggaggtcttcacttcagaaacccaagactcacattcatccagcttggtgtcaagtgggctgttgctgccaggattatcttgtgattatatgaaagatgtatcagtttcttctgaagtgcagtcaactgtagaagcctttgtagcaggtgtgtaacaagtttgttgcatattctaaggacccagacataggcttggtggcccgtctcttgtttttcctggtttatgactttcggctttgtggaatacggctgagatgaaaggatttattgacgatgcaaactactccgttggcctgttggatgaaggaacaaaccttggaaatgttattgataactatgtttatgaacataccctgacaggaaaaaatgcattttttgtgggggatcttgggaagatcgtgaagaagcacagtcagtggcagaacgtggtggctcagataaagccattttacatggtgaagtgcaactccactccagccgtactggagatcttggcagctcttggaactggatttgcttgttccaccaaaaatgaaatggctttagtgcaagaattaggcgtatctccagaaaacatcatttatacaagtccttgtaagcaagcatctcagataaagtacgcagcaaaagttggagtaaatattatgacatgtgacaatgaagttgaattaaagaaaattgcgaggaatcacccaaatgccaaggtcttactacatattgcaacagaagataatattggaggtgaagatggtaatatgaagtttggcactacactgaagaactgtaggcatcttttggaatgtgccaaggaacttgatgtccaaataattggggttaaatttcatatttcaagtgcttgcaaagaatatcaagtctatgtccatgccctgtctgatgctcgatgtgtgtttgacatggctggggagtttggctttacaatgaacatgttagacatcggtggaggcttcacaggaactgaaattcagttggaagaggttaatcatgttatcagtcctctgttggatatttacttccctgaaggatctggcattcagatcatttccgaacctggaagctactatgtatcttctgcatttacgcttgcagtcaatattattgctaagaaagttgttgaaaatgataaattatcctctggagtagaaaaaaatgggagtgacgagccagccttcgtgtactacatgaatgacggtgtttatggttcttttgcaagtaagctttctgaggacttaaatactgttccagaggttcacaagaaatacaaggaagatgagcctctgtttacaagcagcctttggggtccatcctgtgacgagcttgatcaaattgtggaaagttgtcttcttcctgagctgagcgtgggagattggcttatctttgataacatgggagcagattctttgcacggaccgtctgcttttagtgacactcagaggccagctatttatttcatgatgtcactcagtgattggtatgagatgcaagatgctggaattacttcagatgcaatgatgaaaaacttcttctttgcaccctcttgcattcagctgagccaagaagacaacttctccactgaagcttaaacaggcattaacgcttctttagatctgaagtcgcaggttaagcttgtctggtctacattccagtgtggggaaaaattcaatcaatctttattctgttaattttcttggaaacaaattcatagtaatagctgtttgggaccagacaaaatcagctttcatctataattcattgggggtaataggggatttatttagataatgtatccagatttaaacataccagtttgacccaccccttaagcgtttaaaataaaatatgcaacaaaatggatgacttagtggagatggaagcccattaattgggttccccatcaaatcgtttacatacaagtacacagtttttataataaggattcctgttaaaagtcttgtaaagttgatgtctttcacccagatctatcacatgtgagtggaagaccagtgtgacttcattagatacgtttagtgtatttagagtgtgtaaatttgtgctttggactgtagtttaataaatgtaaaattgcatcatagtatttgttgtatttgacctaatgtaaccttgtatgattgcaataaaactttgtgtagattttaccattttttcaggctaaaaatttgggaatggggctagctagcaaaggtagttttgaactagttgtgtgtatggtctgttttgagagttttctttatagtccatttgtttggtttggctcaatatactttttagttatttaattagtaatttaagtaaaaagtgtttggtaatcattgtgaagttcagattcattatggagagtcgatgtgcagtaagcatgatgtttaacaattttaacaccagaaaatgttaatcttgcataaaccaattgtaataataataggtgtttctgtatagataggatgcatagagtaccttagtaaatctttgaatcacaaatcttttggctgatagaaaagattttattaaacactgaaaacttggtcggggatggggagagagactgcagaagactgcagaaccctaaccttaaagaagggctatgtctatttccagcatcctgatgccccttcgcacagacatttaaatcgagagggctttggggtggtgaagcacactcttcaatttctcacttgtaatggtatcaaattgcaatttttttgttgttgctgatcttggtttgaacctagtcccttagtttcttgttaattcccatttgttcaagcttagtaattcttccttccgtactaaagcttggtggggggtggggggaggagttagcttcactaacctgacactgttgccaggaattttggctttgttcactgctagtgtgttagtcctaagtctcagaatcacagaagtaatgagacaacttacaggggtcacttttcctaccttactctatgttcacaagtggaattcctgacctccaagaggaaatgtgacttcactttggtgccaatggacaggaaattctacctgtgctacataggagaagtgtgggatacacttgaatagctggattttacaccttgatttcaaggtggaaagaaattgatcatgaatctctaatttcaaatcaaaccagtaggtgcttaatatttttgatttgaatattgcccacttgaatatcatgggttctattaattataagaacaactaaggaccccagtccactgtcatctagttgcccttggacttttttccaaggtatactatggggtttatgcaaaatttgaagctaccatatgcattgttgtggtccaggaatgccaaaacttaaagcgtggtacaacctgagtccttggcctgactgtacaggcgtggtctctgtggcatcagttttgccttctgcataggagaaaggttgtatgtaacacagcccggaattgctatctcacatgtgaatgataggtaaacataagaatgtctgtattgtttttgaagactgtttgccataaatctaaagtcaaacctatgtatttcaatttggtatgcttaagaataattaatgtaaaatctttttatatgatattgtaatctcagttcaaatttaattgcaaatataaaacccaaatgatttctatatatagtaaattgaactgtcaaggtaacttgtgtgtgattctgaatacacagatacaatgtttttattcctcatgctttactttgatggcttctatcatgaaatagatgtgaaattttatgaaaaaaa

SEQ ID NO: 2142 - DNA, 2741 bp, Rattus norvegicus
  Genbank Accession No. NM_022588
ccgccggcgcccccgcgcccgcccccgccccggcccgcgcccggcccgccgcccgcgcccgcgccccgcgcccgcggccccgccgccggcccggacatggccgccaacatgtacagggtcggagactatgtctactttgagaactcctccagcaacccgtacctgatccgcaggattgaagagctgaataagacagccaacgggaatgtggaggccaaagtggtgtgtttctacagaaggcgggacatttccagcagcctcatcgcgctggctgacaagcatgcaaccctgtcagtctgctatagagccggaccgggggcggacaccggcgaggaaggggaagtggaggaggaggtagaaaacccagagatggtagacctgcctgagaaacttaagcaccagctgcggcatcgggaactgttcctctctcggcagttggagtctctgcctgccacccacatcaggggcaagtgcagtgttaccctgctcaatgagaccgagtcactcaagtcctacctggagcgtgaggatttcttcttctactctctagtctacgacccacagcagaagaccctcctggctgataaaggcgaaattcgtgtagggaaccggtaccaggctgacatcactgatttgctgaaagacggtgaggaggacggccgcgatcagtcgaagctggagaccaaggtgtgggaagcccacaatccacttgtagataagcagattgaccagtttctggtggtggcccgctctgtgggtacctttgcacgggccctggattgcagcagctccgtgcggcagcctagcctgcacatgagtgccgccgcagcctcccgagacatcaccctgtttcatgccatggacacgctgcacaagaacatctacgacatctccaaggccatctctgcccttgtgcctcagggtgggccagtgctctgcagggatgagatggaggagtggtcagcatcagaagccaacctttttgaggaagctctggaaaaatatgggaaagatttcacagacattcagcaagactttctcccatggaagtcgctcaccagcatcattgagtattactacatgtggaagaccaccgacagatacgtccagcagaaacgtttgaaagcagctgaagcagagagcaagttaaagcaggtttatattcccaactataacaagccaaacccaaaccagatcagcgtcaacagtgtcaaggccagtgtagtgaatggcacagggacaccaggccagagccccggggccggtcgggcctgcgagagctgttacaccacacagtcttaccagtggtattcttggggtccccctaacatgcagtgtcgcctctgcgcatcttgttggacatattggaagaaatatggtggcttgaaaatgccaacccggttagatggagagaggccgggaccaaaccgcaataacatgagtccccatggcatcccagctcggagcagtgggagccccaagtttgccatgaagacaaggcaggccttctacctgcatactaccaagttgacacgcattgcccggcgcttgtgccgtgagatcctacgcccatggcatgccgcacgccacccctacatgcccatcaacagtgcagcaatcaaggctgaatgcacagcacggctgcccgaagcttcccagagcccactggtgctgaagcaggtagtacggaagcccctggaggctgtgctccggtatcttgagactcatccccgcccgcctaagcccgaccctgtgaagagctcatccagtgtgctcagcagtctgacccctgccaagtcagcccctgtcatcaacaatggctcccctaccatcttgggcaagaggagctatgagcagcacaatggggtagatggtctggcaaaccatggacagaccaggcacatgggaccaagtcggaatctcctgctcaatgggaagtcctaccccaccaaagtgcgcctaatccgaggcggctccctgcctccagtcaagcggcggcggatgaactggattgacgccccagatgatgtattttacatggccaccgaggagaccaggaaaatccgaaagctgctctcatcttcagaaaccaagcgtgctgcccgccggccctacaagcctattgccctgcgccagagccaggccctgccgctgcggccacccccacctgcaccagtcaatgatgagcccattgttattgaggactaggcggtcacccacagtggcctgcctgggcccctccatcagccccagagtatccagtgaggcctgcagaggccaagcggcctccctcccccaccagactgctgcccaccccaccctctgtttccgtagtgccccaactcccgccctcacatgcagagaaactgctcctctggtggacatgcgggggaagaagtgtggtctaacttattccaagacaccgaggagtcttttttagctttgtgtttactttctggctggagcagagatgaggagtgccctgggccgtgggctgcagggcttctcagctggggtgggctctaaggttttgttgtgttctgttgaaggtgccattttaaattttatttttattacttttttgtagatgaacttgagctctgtaacttacacctggaatgttaggattggtgcagccagcagcggccaagctgcctggcagggttggtcccttgtcttttcaagtaattttcatattaaacaaaaacaaagaaaaaaatctcataaaaaggaaaacccca

SEQ ID NO: 2143 - DNA, 1097 bp, Rattus norvegicus
  Genbank Accession No. NM_022594
agctccagagatggctaccgcgatgacagtttccagcaaactcctcggcctgctgatgcagcagctgagaggtacccgccagctgtacttcaacgtcagccttcgatctctgagctcctctgcacaagaggcgtccaaaagaatccctgaggaagtctcagaccacaactacgagtctattcaagtaacatctgcccagaagcatgttctgcatgtacaactaaaccggccggagaagaggaatgccatgaacagggctttctggagggagttggtggaatgcttccaaaagatatctaaagactccgactgtcgggctgttgtggtctctggtgcaggaaagatgttcacttcaggtattgacctcatggacatggcatcagacatcctgcagcccccaggagacgatgtggcccgcatagcctggtacctccgagacctcatcagccgataccaaaagactttcactgtcattgagaagtgccccaagccggtgatcaccgcaattcacggaggctgcattggtggaggcgtggatcttatttctgcctgtgacattcgctactgcactcaggatgctttcttccaagtcaaggaggtggatgtgggcctggctgctgatgtaggaacgctgcagcgactgcccaaggtcattgggaaccggagcctggtcaacgagctgaccttcaccgcccgcaagatgatggctgacgaggccctggacagtgggctggtcagccgcgtgttcccagataaggacgtcatgctgaatgcagcctttgccctggcggccgatatttccagcaagagtcctgtggctgtgcaggggtcaaaaatcaatttaatctactcccgagaccattctgtggacgagagccttgactatatggccacttggaacatgagcatgctgcagacccaggacatcatcaagtcagtccaggcagccatggagaagaaggactcaaaaagcatcaccttctccaagctctgagtgccttcctgaccctggtcccctcagtgcctcctcccggtgtataactttatgacttagttcttcagttcccggggccttatctccactgtgaacaataaag

SEQ ID NO: 2144 - DNA, 1640 bp, Rattus norvegicus
  Genbank Accession No. NM_022598
agagccgtgcgcagcggcgtgtgtggggccgtgtgcagacccgcgtgtggcgcaggcaaggaccctgaaaataaacagccgctgctttgcgagtctccttcttgggtctacgtccgagtctcctctgctgtgggcagctcagacgccgaagctctaactgcagctatgagcagcaacgaatgcttcaagtgtggacgatctggccactgggccagggaatgccctactggtggaggtcggggtcgtggaatgagaagccgcggcagaggtggttttacctcggatagagggttccagtttgtttcctcgtctcttcctgacatctgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaagccaggccatctggctcgtgactgtgaccacgcggacgagcagaagtgctattcctgtggggaatttggacatattcaaaaagactgcaccaaggtgaagtgctataggtgtggtgaaactggtcatgtagccatcaattgcagcaagacaagtgaagtcaactgttaccgctgtggcgagtcagggcatcttgcacgggaatgcacaattgaggctactgcctaattattttcctttgtcgcccctcctttttctgattgatggttgtattattttctctgaatcctcttcactggccaaaggttggcagatagaggctgttcccaggccagtgagctttacttgcagtgtaaaaggaggaaaggggtggaaaaaaaaccgaatttctgcatttaactacaaaaaaagtttatgtttagtttggtagaggtgttatgtataatgctttgttaaagaaccccctttccgtgccactggtgaatagggattaatgaatgggaagagttcagtcagaccagtaagcccttctgggtttgagtgtgttcccatgtaggaggtaaaaccaattctggatgcatctaagcttccatgaataactttaattcttagcataatgatggccttggattgtctgacctcagtagctattaaataacatcgagtaacatctgcatcaggccctcatagaacattcagttgagttgggagtaaactgaaaagacaaatgtgttgaaggatatgccagggaatctggctaaagcctaatacaggagcatcttcatcccagtgttgatgctggacgtacagaaggtgatggcaaaggtgtagaacacattttttcaaagactaaatctaaaacccagagtaaacatccgatgctcagagttagcataatttggagctattcaggaattgcagagaaatgcattttcacagaaatcaagatgttatttttgtatactatatcacttagacaactgtgtttcatttgctgtaatcagtttttaaagtcagatggaaaaagcaactgaagtcttagaaaatagaaaatgtaattttaaactattccaataaagctggaggaggaaggggagttttgactaaagttccttttgtttgttttaaattttcatcaatgtatatagaacaaaatgccatattaaaga

SEQ ID NO: 2145 - DNA, 2133 bp, Rattus norvegicus
  Genbank Accession No. NM_022602
cgctcggccagctgccgtctacgggcttccgcgcggccaccgggcaactgcgccgcgcggctgccccactgagcgctcggcctcggggccgtgggatccgccgcgctgtctgcggtcaggaagaccgccctcccgcgtccgtgccggacgggtcagaggcggcgccgcacgcgaggccacccgcgatgctgctgtccaagttcggctccctggcgcacctctgcgggcctggcggcgtggaccacctcccagtgaagatcctacagccagccaaggcggacaaggagagcttcgagaaggtgtaccaggtgggcgccgtgctcggcagcggcggcttcggcacggtctacgcgggcagccgcatcgccgacggactcccggtggctgtgaagcacgtggtgaaggagcgggtgaccgagtggggcagtctcggcggaatggccgtgcccctggaggtggtgctgctgcgcaaggtgggcgcggcgggcggcgcgcgcggcgtcatccgcctgctggactggttcgagcggcccgacggcttcctgctggtgctggagcgacccgagccggcacaggacctcttcgacttcatcactgaacgcggcgccctggacgagcctctggctcgtcgcttcttcgcgcaggtgctcgccgctgtgcggcactgccacaattgtggggtcgtgcaccgcgacatcaaggacgagaacctgctggtggacttgcgctcgggcgagctgaagctcatcgacttcggctcgggcgcggtgctcaaggacacggtctacactgactttgatggcacccgtgtgtacagccccccagagtggatccggtatcatcgatatcacgggcggtctgccactgtgtggtctctgggtgtactgctctacgacatggtgtgtggggacattccctttgagcaggatgaggagatcttgcgcggcaggctctttttccggaggagggtctccccagagtgccagcagcttattgagtggtgtctctccctgcggccctcagagaggccctcgctggaccaaattgctgcccatccctggatgctggggacagagggcagcgttccagagaactgtgaccttcggctctgtgccctggatactgatgacggagccagtaccacttccagcagtgagagcttgtgaggaggaggaggggcctggactccacactgggggcctgggctcagcctagccagccctctcccagaatgaacattttctgcctgggatgtctcctgcaaaagcagtgacctctgacccctggtgacctttgctctcggcaccgggcctgtttcctttgctttgagtgcctttttgaacgctgctccacagggcctgggttttcttgagctcttctgtccaaagatggctgcgggctaagcaaggtcccgcctgccctgggtggatacttgaacccgagaccctaccctgctgctccatcttgcggcagccttcctgaccaagtgtgtttgacatggagcgccctgtggtgcccacctccaaccctccagtctcctggtcttcgtctgggcatgtctgcacaagcaatgcaacgctgggccactgctgcccgcctgcctccctggcaccgcacgcaacgagcgtgccacggtctcttatttatggtgtgatcaccctggagggcgcccctgccctgctggggctatttattgtttaatttatttgctgaggttacttcctccaagcaaccaccttctccaggcccctggggtgttcaggaaagccaagggtggccgttcagtccacagacggcatcctggttcctgcacctgcagtaggtccctaaccccatgtttgtgggaggaggaatttgtacagtggctaatttaaggggagtgggagaccctgtcaccctgggcactctgcgctggggagggggtttaaattattgaccttgtacagtctgcttgctggctctgaaagctggggtgggggacagagtctcaagcccttaatttattttagcaactgtgttctgtgaccctggtgtgagtaggcatcaggggtggggttgtataagttcaaaagtgtgaaatgtctggagatcatattttttatacaggtatttcaattaaatgttttggtatat

SEQ ID NO: 2146 - DNA, 1318 bp, Rattus norvegicus
  Genbank Accession No. NM_022606
cgccgcccaggctagcgcgagcctccgctccatcgccccgccgccatggacctattcggggacttgccggagcccgagcgcccgccgcggccgtctgccgggaaagaagcacaggaaggacccgtgctcttcgaggacctgcccccgaccagcagtactgactcaggatctgggggacctttactctttgatggtcttccacctgctggcagcggcaattcaggttctcttgccacatcaggctcccaggtggtgaagaacgaaggaaaaggagcaaagaggaaagcccctgaggaagagaagaatggcggtgaagagcttgtggaaaagaaagtttgtaaagcctcttcggtgatctttggtttgaaaggctacgtggcagagcggaagggtgagagggaggagatgcaggacgcccatgtcatcctgaatgatatcactcaggagtgtaatcctccatcatctctcattactcgggtttcatactttgctgtttttgatggacatggaggaattcgagcctcgaaatttgctgcacagaatttgcaccagaacttaatcaggaaatttcctaaaggagatgtaatcagtgtggagaagactgtgaagaggtgcctgctagatacttttaagcacaccgatgaagagttcctgaaacaggcttcaagccagaagcctgcctggaaagacgggtccactgccacgtgtgtcctggctgtggacaacatcctgtatatcgccaaccttggagatagtcgggcaatcctgtgtcgatataacgaggaaagtcaaaagcatgcagccttaagcctcagcaaagagcacaatccaactcagtatgaagagcgcatgaggatacagaaggctggaggcaatgtcagagatggccgtgtcttgggtgtgctggaggtatcccgctccattggagatgggcagtacaagcgttgcggggtcacatccgtgcctgatatcagacgctgccagttgacccccaatgacaggttcattttgctggcttgtgatgggctcttcaaggtctttaccccagaagaagctgtgaacttcatcttgtcctgccttgaggatgagaagatccagacccgagaagggaagcctgctgttgatgcccgctatgaagctgcatgcaacaggctggctaacaaggcagtgcagcggggctcggcagataacgtgacggtgatggtggtgaggataggacactgaggccgcacactgcacgtgtgctcttgacttgcaggttcatcttgtttgtgcacgctgtgtgtactcctgtggggcttctatggttgtaaataaa

SEQ ID NO: 2147 - DNA, 811 bp, Rattus norvegicus
  Genbank Accession No. NM_022674
gccttttctctgccttgcttgcttgagctccagcacagtccgagatggctggcggtaaggctggaaaggactccggaaaggccaagacaaaggcggtttcccgctcccagcgagcgggcttgcagttccctgtgggccgtattcatcgacacctgaaatctaggacaacaagccacggacgtgtgggcgcgaccgcagctgtgtacagcgcagccatcctggagtacctcaccgcagaggtacttgagttggcaggaaatgcatcaaaagacttgaaggtaaagcgtattacccctcgtcacttgcaacttgctatccgcggagatgaagagttggactctctgatcaaggctacgattgctggtggtggtgtcatcccacacatccacaaatcactgattgggaagaaaggacaacagaagactgtctaaggatgcctggattccttgttatctcaggactctaaatactcttaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgaatctgaagtggtgggttttgattgagttgactgtttttaaaaaactgtttggattttaattgtgatgcagaagttatagtaacaaacatttggttttgtacagacattatttccactctggtggataagctcaataaaggtcagatcccaaactaaaa

SEQ ID NO: 2148 - DNA, 619 bp, Rattus norvegicus
  Genbank Accession No. NM_022676
gcggccatggagcccgacaacagtccacggaagatccagtttacggttccgctgctggagcctcacctggacccggaggcagccgagcagattcggaggcgccgccccacccctgccacacttgtgctgaccagcgaccagtcatccccagaagtagatgaagaccggatccccaacccacttctcaagtccacactgtcaatgtctccacggcaacggaagaagatgacaaggactacacccaccatgaaagagctccagacaatggttgaacatcacctagggcaacagaaacaaggggaagaacctgagggagccactgagagcacagggaaccaggagtcctgcccacctgggatcccagacacaggctcagcgtcaaggccagatacctcggggacagcacaaaagcctgcagaatccaaacccaagactcaggagcagcgtggtgtggagcccagcacagaggacctttcagcccacatgctaccactggattcccaaggagccagcttggtctgacagaagttgacatccggggatcgccagtgagtgtggaagttcatggacactggatgtttcttaatctcttgtttttaaacgtgataaatttggtgtt

SEQ ID NO: 2149 - DNA, 377 bp, Rattus norvegicus
  Genbank Accession No. NM_022686
acttttactcacaaccatgtctggacgtggtaaaggtggtaaagggcttgggaaaggtggcgctaagcgtcatcgcaaagtcctgcgcgacaacatccagggcatcacaaagcccgccatccgccgcctggcccggcgcggaggagtgaagcgcatctccggcctcatctacgaggagacccgcggtgtgctgaaggtgttcctggagaacgtgatccgcgacgccgtcacctacacggagcacgccaagcgcaagacggtcactgccatggacgtggtctacgcgcttaaacgccagggccgcacactctacggcttcggtggttaaactgctaatgcgctttccttagctgttgcaaaaggcccttttcagggcc

SEQ ID NO: 2150 - DNA, 633 bp, Rattus norvegicus
  Genbank Accession No. NM_022689
atggatgatctatcaccagaagaaattcagcttcgggctcaccaagttactgatgagtctctggaaagcacaaggagaatcctgggtttagccattgagtctcaggatgcaggaatcaagactatcactatgctggatgagcaaggggaacaactaaatcgcatagaagaaggcatggaccaaataaataaagacatgagagaggcagagaagactttaacagaactcaacaagtgttgtggcctctgcgtctgcccttgtaataggaccaagaactttgagtctggaaagaactataaggcaacatggggtgatggtggagacagctcacctagcaatgtggtatctaagcaaccaagccggataacaaatggtcagcctcagcagactacaggagcggccagcggtggatacattaaacgcataactaatgatgccagagaagatgagatggaagagaacctgactcaagtgggcagcatcctagggaacctaaagaacatggctctggatatgggcaatgaaattgatgctcaaaaccagcaaatacagaagatcacagaaaaggctgacaccaacaagaatcgcattgacattgccaatacaagagcaaagaaactcattgacagctaa

SEQ ID NO: 2151 - DNA, 3166 bp, Rattus norvegicus
  Genbank Accession No. NM_022694
ccgtgcaacggggcatcgtcaagatggtcctctctgggtgtgccatgattgtccgagggctgccccgtggtaccgctccagagaggcagatcaacctcagcaacattcgagctggaaatctcgacacacgtcgtcgagctgctacacaaccagatgggaaagataccccagatgagccctgggcatttcctgctagagagttccttcgcaagaagctgattgggaaggaagtctgtttcacgatagaaaacaagactccccaaggacgagagtatggaatgatctaccttggaaaagatactaatggggaaaacattgcagagtcgctagtcgcagaaggcttggctcccggagagagcatgagagccaataatccagagcagaaccggctttcagaatgcgaggaacaagcaaaggcatcgaagaaagggatgtggagtgaggggacgggtcacacacatccggacctcaagtacaccattgagaacccaaggcactttgtggactcacaccaccagaagcctgtcaatgctatcattgagcatgttcgagacggcagtgtggtccgggccctgctccttccggatcactaccttgttaccgtcatgctgtcagggattaagtgcccaacctttcgtcgagaaacagatggtagtgaaacaccagagcccttcgctgcagaagccaagtttttcacggagtctcgactgcttcagagagatgttcagatcattctggagagctgccataatcagaacattctgggcaccatccttcatccaaatggtaacatcactgaactcctcctgaaggaaggttttgcccgctgtgtggactggtcaattgcagtttacacccggggtgcagaaaagctgagggcagctgagaggtttgccaaggagcgtaggctgagaatatggagagactatgtgcctcctactgctaatttggaccaaaaggacaagcagtttgttgccaaggtaatgcaggttttgaatgctgatgccattgttgtgaagctgagttctggagactacaagaccatccacctgtcaagcatccgaccaccaaggttggagggagacaacatacaggataagaataagaagctgcgtcccctgtatgacatcccctacatgtttgaggcccgggaattccttcgcaaaaagctgattgggaagaaggtcagtgtgactgtggactacattagaccagccagcccagccacagaaacagtgcctgccttttctgagcgtacctgtgccacagtcaccattggaggaataaacattactgaggcccttgtcagcaaaggcctagccacagtgatcagataccggcaggatgatgaccagagatcttcacactatgatgagctgctggctgcagaggccagagcgattaagaatggcaaaggattgcacagcaagaaggaagtgcccatccaccgagttgcagacatttctggggacacccagaaagcaaagcagttcctgccctttcttcagcgcgcaggccgttctgaggctgtggtggagtatgtcttcagtggctctcgcctcaagctctacttacctaaggagacctgtctcatcaccttcctgctggcaggcattgaatgtcccagaggagcacgaaatctcccaggcttggtgcaggaaggagagccattcagtgaggaagccacacttttcaccaaggaactagtgctgcagcgagaggtggaggtggaggtagagagcatggataaggctggcaacttcattggctggctacacatggatggggctaacctgtctgtcttgctggtggagcacgcgctctccaaggtccacttcactgctgagcgcagcggctactataagcctctcctgtctgctgaggaagctgccaagcagaggaaagagaaggtctgggcccactatgaggagcagcctgtggaggaggtaatgcctgtactggaagagaaggagcgctcggccagctacaagccagtgtttgtgaccgagatcacagatgacctgcatttctatgtgcaagatgtggagactggcacccagctggaaaaactgatggagaacatgcgcagtgacatctccagccaccctcctgttgagggtctacgcccacgccggggagagttctgcattgccaaatttgtagatggagaatggtaccgcgcccgggtagaaaaagaggagtcccctgccaaagtgcatgtcttctacatcgactatggcaatagagagatcctgccatccacccgcctggccctaccacctgccttcagcactcgcgtgttgccagctcaagccacagagtatgccttcgccttcatccagtggccccaagatgaggacgctcgcacagatgctgtgacagtgtgtgcggacatccaaaacactcagtgcctgctcaacgtggagcacctgagtgccagctgcccccatgtcactctgcagtttgcggattccaaaggtgatgtggggctgggcctggtgaaggaaggactcgtcatggtagaagttcggaaggagaagcagttccagaaagtgatcacagagtacctgaatgcccaggaatcagccaagagtgccaggctgaacctgtggcgctatggcgacttccgagctgacgatgctgatgagtttggctacagtcgctaaggagaacttgcctggctcccagcaccgatgatgccagaccttctccctctgccaggaagccgttttcaactccagacctggtcgggggagtatagattgggtccagcttgcttcagacagaaacctcctctgtcgcgggtagcattggagctggggtggagagcccaaggcttgctggggcagacccctcagtggtactgccgtccagtctctcccagatgattttgtatttttatttaattgtcttcaaatcaggaaagaaccatgaaagactgtgtgttagtgaagggtataatcgtgacacagaggcagctgtcagctggcacccacctctcccccagaccacccttcttcccaagctctgtccaagtgttgattatgtgacttctgatacatccgttctcaaattccagtgtgcccatatctgcccccacaccagcctgttctgtatttaaagcttttgagacccaataaaatagtacctgctgtctgcaaaaaaa

SEQ ID NO: 2152 - DNA, 466 bp, Rattus norvegicus
  Genbank Accession No. NM_022697
ctttccgtctccggccgccgcaggagaggagtcgccgccatgtccgcgcatctgcaatggatggtcgttcggaactgctccagtttcttgatcaagaggaataagcagacgtacagcacggagcccaataatctgaaggcccgaaactccttccgctacaacgggctaattcaccgcaagacggtcggagtggaggcctggcctgatggcaaaggggtcgtggtggttatgaaacgcagatccggtcagcgaaaacctgccacttcctacgtgaggaccaccatcaacaagaatgctcgggctaccctcagcagcatcaggcacatgatccgaaagaacaagtaccgccctgatctgcgtatggcggccatccgcagagccagtgccatccttcgaagccagaagcctgtggtggtgaagaggaaacggacccgccccaccaagagctcctgagccccacaccccg

SEQ ID NO: 2153 - DNA, 1015 bp, Rattus norvegicus
  Genbank Accession No. NM_022698
atgggaaccccaaagcagccctcgctggctcctgcacacgccctaggcttgaggaagtccgatcccggaatccggagcctggggagcgacgcgggaggaaggcggtggagaccagcagcccagagtatgttccagatcccagagtttgagccgagtgagcaggaagacgctagtactacagataggggcctgggccctagcctcactgaggaccagccaggtccctacctggccccaggtctcctggggagcatcgttcagcagcagccgggacaggcagccaataacagtcatcatggaggcgctgggactatggagacccggagtcgccacagttcgtacccagcggggactgaggaagatgaagggatggaggaggagcttagcccttttcgaggacgctcgcgctcggctccccccaatctctgggcagcgcagcgctatggccgtgagctccgaagaatgagcgatgaatttgagggttccttcaagggacttcctcgcccaaagagcgcaggcactgcaacacagatgcgacaaagcgccagttggacgcgcattatccagtcctggtgggatcgaaatttggggaaaggaggctccactccctcccagtgatctgctccacattcccggaattctacccgctcccatcgcccgccatattgggtgtgggcggaagtctttcgaggccttaggaaaaaaggatcgctgtgtccctttaacagggagaagagctgacgtacagcgttgagttccttccggtgcgtgcaatagccatggaggggtggcccttgctttggagttttcaaagttttccacacaccctaccccctacgcctccggaagtggctatgttccctctccgttactggacagccctcaggcgcctgtgctaagttgcgagtcctggtaaaccgagactgggtgctgtcctatcatcctagctggaggccccaggtcaagaaacgtgctttataataaagcccgcgcatgtgtaaaaaaaaaaaaaaaa

SEQ ID NO: 2154 - DNA, 392 bp, Rattus norvegicus
  Genbank Accession No. NM_022699
atggtggctgcaaagaagacgaaaaagtctctggagtcaatcaactctaggctccaacttgttatgaaaagtggaaagtacgtgctggggtacaaacagactctgaagatgatcagacaaggcaaagcgaaattggttatcctcgccaacaactgtccagctttgaggaaatctgaaatagaatactatgccatgttggctaaaactggtgtccatcactacagtggcaataacattgaattgggcacagcgtgtggaaaatactacagagtatgcacactggctatcattgacccaggtgattccgatattattagaagcatgccagaacagactggtgagaagtaaacaagaaagttctcctttaataaaactttgccagagctcctttt

SEQ ID NO: 2155 - DNA, 2157 bp, Rattus norvegicus
  Genbank Accession No. NM_022701
gaatctgttggcacggaggaagaagtccctggggaatcttaggactgtcacaggggcgctcaagggactgggcggtggcagaggcagttctcctgataggagggggaagaggtgccacagggccccttcccctctgcaaaggcttcttctctctcccctccagttgcagcctcaactatgtttttcacttgtggcccaaatgaggccatggtggtctccgggttctgcaggagccccccagtcatggtggccggaggccgagtgtttgtcctaccctgcattcaacaaatccaaaggatctctctcaacacactgaccctcaatgtcaagagtgagaaggtttatacccgccacggggtccccatctcagtcacgggcattgcccaggtgaaaatccaggggcaaaacaaggagatgctggcagctgcctgccagatgttcctggggaagacagaggcagagatcgcccacattgccctggagacgctggaaggccaccagagggcaatcatggcccacatgactgtggaggagatctataaggacagacagaagttctcagagcaggttttcaaggtggcctcctccgacctggtcaacatgggtatcagtgtggttagctacactttgaaggacattcacgatgaccaggattacttacactctttggggaaggctcgcacagcacaagtgcagaaagatgctcggattggagaagcagaggccaagagagatgcggggatacgggaggctaaggccaagcaggagaaggtatccgcacagtgcctcagtgaaatagagatggccaaggcccagagggactatgagctgaagaaagccacctacgacattgaggtcaacacccggcgagcacaggcggacctggcctatcagctgcaggtggccaagacgaagcagcagatcgaggagcagcgggtacaggtgcaggtggtggagcgcgcccagcaggtggcagtgcaggagcaggagatagcaaggcgcgagaaggagctggaggcccgggtgcgcaagccagcggaggctgagcgctacaggctggagcgcctggcggaagcagagaaggcccagctgatcatgcaggcagaagctgaagctgagtctgtgcgggtgagttggggcatggcttctgattggcatgaggggagggcttatcagggtttcttgttctctattgcttgttttttgtcctggctgacctggaactcactgtgttaacaagatggcttcaaactcggggagatccatctacctctgcctcccaattactgggattaaaggcattcacaactgttgttgctgtcgctgttgctaacctcctcccttcttccctccttctcctcctccttctccccctctccccacgccccatgtaggaggcagggtggttcatcttgccagtgtggaggtcagatccccctggagattttaagtaaggttgttggcctgactggcaagcacctttaccctctgagtcttattggcctcagaatttggtatccttaatgagttgcctgcccgtaccctccacagatgcgaggggaagctgaggcctttgccgtaggggcccgcgctcgtgctgaggctgagcaaatggccaagaaggcagaagccttccagatgtaccaggaggccgcccagctggacatgctgctggagaaactgccccaggtggcagaagagatcagtggccccctgacctcagccaataagatcacgctggtgtctagcggaagcggaaccatgggggccgccaaagttactggggaagtactggacatcttaagccgtctgccagagagtgtggagagactcacaggcgtcagcatctcccaggtgaatcacaacaagcctttaaggacggcgtgagcccttccaagttcccaatggtacctggacatgtggcccaatggtctcattgcatgcgcctcagttggcctccctgagcatgaccccctgccaagggtgcacatctctccttgccaaatagtctgtgccttgccttggagggcttgctctccgcccatttgccagtgccctgcaccaagactttggttatcttacttcaccccaactatttaacttcctgattaaacgagactgagccctctgggtagctataaaaaaaaaaaaaaaaaa

SEQ ID NO: 2156 - DNA, 2756 bp, Rattus norvegicus
  Genbank Accession No. NM_022715
tgtggcttgcagctgccagctaccctgctaaatgtttggtgggaaaagcttgggattcaccatggcaactgaagaggccatcatccgcatccccccataccactacatccatgtgctggaccagaacagtaatgtgtcccgtgtggaggttggaccaaagacctacatccggcaggacaatgagagggtactgtttgccccagttcgcatggtgaccgtccccccacgccactactgcatagtggccaaccctgtgtcccgggacacccagagttctgtgttatttgacatcacaggacaagtccgactccggcacgctgaccaggagatccgactagcccaggaccccttccccctgtatccaggggaggtgctggaaaaggacatcaccccactgcaggtggttctgcccaacacagcactgcatcttaaggcgttgctggactttgaggataagaatggagacaaggtcatggcaggagacgagtggctatttgagggacctggcacctacatcccacagaaggaagtggaagtcgtggagatcattcaggccacagtcatcaaacagaaccaagcactgcggctaagggcccgaaaggagtgctttgaccgggagggcaaggggcgcgtgacaggtgaggagtggctggtccgatccgtgggggcttacctcccagctgtctttgaagaggtgctggatctggtggatgctgtgatccttacagaaaagactgccctgcacctccgggctctgcagaacttcagggaccttcggggagtgctccaccgcaccggggaggaatggttagtgacagtgcaggacacagaagcccatgttccagatgtctatgaggaggtgcttggggtagtacccatcaccaccctgggacctcgacactactgtgtcattcttgacccaatgggaccagacggcaagaaccagctgggacaaaagcgtgttgtcaagggagagaagtcctttttcctccagccaggagagaggctggagcgaggcatccaggatgtgtatgtgctgtcagagcagcaggggctgctactgaaggcactgcagcccctggaggagggagagagcgaggagaaggtctcccatcaggccggagactgctggctcatccgtgggcccctggagtatgtgccatctgcaaaagtggaggtggtggaggagcgtcaggctatccctctggaccaaaatgagggcatctatgtgcaggatgtcaagacggggaaggtgcgggctgtgattggaagcacctacatgctgactcaggatgaagtcctgtgggaaaaggagctgccttctggggtggaggagctgctgaacttggggcatgaccctctggcagacaggggtcagaagggcacagccaagccccttcagccctcagctccaaggaacaagacccgagtggtcagctaccgtgtcccgcacaatgcagcggtgcaggtctatgactacagagccaagagagcccgtgtggtctttgggcccgagctagtgacactggatcctgaggagcagttcacagtattgtccctttctgccgggcgacccaagcgtcctcatgcccgccgtgcactctgcctactgctgggacctgatttctttactgatgtcatcaccatcgaaactgcagatcatgccaggttgcagctgcagcttgcctacaactggcactttgaactgaagaaccggaatgaccctgcagaggcagccaagcttttctccgtgcctgacttcgtgggtgacgcctgcaaggccattgcatcccgagtccggggggctgtagcctctgtcacctttgatgacttccataaaaactcagcccggatcattcgaatggctgtttttggctttgagatgtctgaagacacaggtcctgatggcacactcctgcccaaggctcgagaccaggcagtctttccccaaaacgggctggtagtcagcagtgtggatgtgcagtcagtggagcccgtggaccagaggacccgggatgcccttcagcgcagcgttcagctggccatcgaaattaccaccaactcccaggaggcagcagccaagcacgaggctcagagactggaacaggaagcccgtggtcggcttgagaggcagaagatcttggaccagtcagaagctgaaaaagcccgcaaggaactcttggagcttgaggctatgagcatggctgtggagagcacgggtaatgccaaagcagaggctgagtcccgtgcagaggcagcgaggatcgaaggagaaggctctgtgctgcaggccaagctcaaggcacaggcgctagccattgagacggaggctgagttggagcgagtaaagaaagtacgagagatggaactgatctatgcccgggcccagttggagctggaggtgagcaaggcgcagcagcttgccaatgtggaggcaaagaagttcaaggagatgacagaggcactgggccccggcaccatcagggacctggctgtggccgggccagagatgcaggtgaaacttctccagtccctgggcctgaaatccactctcatcaccgatggctcgtctcccatgaacctcttcagcacagcttcgggttgctggggctggggtctgatggtcagccgccagcacagaagtgatccggcagcccggggaagacttgctctcccaggctctccgaagcagccatgctgtgccttaggtcaacactgactgcactgacaatggataaaataaattgacaactgta

SEQ ID NO: 2157 - DNA, 6683 bp, Rattus norvegicus
  Genbank Accession No. NM_022861
gggtaatcggattcaaaacaacattagagcaacaactttgcctacatacaatctggtatcacggtcgcctcgttcagcaaagcagacgaggatcgcttgtatttctgaaaaccggaaataaagacactttcagtttgagaaaggggcagacggaagcaatggtcacacagaagaggacacacctcctgagatttccttttcaaatgtcctacgtggacagcctctggaggatggagtccgtggtttcgctgaatgcgtttacctctaggcgtggcctgtagtgagcgtcactccaccctgccatagccaggtgctctaatggtgctctagtagtgactagagataccccacgcagggtgaagccctcatctaggctgtgaagtgatctgttttggaaagtatgagggttttaataagacagtgcacaggacaacctgagaataggagaaaagcgtcacaatagaataaaggtcactatctatcatgtcaccattcctcctggagggagccccaggcttgagaagggacgtggaaaccggtaggagtcggggtggggggggatcctctccacagtcagagaagcagaaaataactcccaggaggagggcctctcagaaaggccatgcagaagaaccttcaggagactctctttcccatccaaggcttcggcttcccatgactggaagggctttttggtcacacgggctgtttcggtcatctgtgctcctctaagtaattacttatccacactcctgaatgacttcagtagaatcatcagcttgatcactagcacttccctatctgcggtgagcagacgtctgtgctgtgtctgctcagaaaagtctcaaacaatggccaccgatggaaacctcccagggcagatcctactcaactgcttcttcgagtcggatgactcaagatgcttcagttcccactgactgtctctagccagcatggtcttaaccagagaagataatcaagaacaattagaaaaggtattgaagtgggaaatggagggtcggggatgaagcgacatggccggcgaccgggccccagcgtaagctctgagccccgcgctgcgcccgccgcgctctggccgcctggagtcatgtctctgctgtgcgtgggagtcaaaaaagccaagtttgacggtgcccaagagaagttcaacacatacgtgacgctgaaggtgcagaacgtgaagagcactaccatagctgtacgcggcagccagcctagctgggagcaggacttcatgtttgagatcaaccgcctggatctgggcctgacggtggaggtgtggaacaagggtctcatctgggacacaatggtgggtactgtgtggatcccacttcggaccatccgtcagtccaatgaggagggtccgggagaatggctgacactggactctcaggccatcatggcggacagtgagatctgtgggaccaaggaccccaccttccaccgcatcctcctggacgcacattttgagctgcctttggacatccccgaggaggaggcgcgctactgggccaagaagctggagcagctgaatgccatgcgtgaccaagatgagtactcctttcaggaccagcaggacaagccactgccggtgcccagcagccagtgctgcaactggaattactttggctggggagaacagaatgatgatcccgacagtgccgtggatgaccgggacagtgattataggagtgagacgagcaacagcatcccaccgccttactacacgacttcgcagcccaatgcttcggtgcaccagtactccgtgcggccaccccctctggggtcccgggagtcctacagcgactccatgcacagctatgaagagttctctgagccgcgggcactcagtcccacaggcagcagccgctatgcttccagtggggagctgagccagggcagctcccagctgagtgaggacttcgacccggatgagcacagcctacagggctcagagctggatgacgagagggaccgagattcttatcactcctgccacagctctgtgagctaccacaaggactcaccccgctgggaccaggatgaggaggacctggaggacctggaggacctggaagatgaggagttgcccgaggaagaggagttggaagaggaggagttggaggaggaggaggagttggaggaagaggaattggagttggaggaggaggaggaggtgcctgatgacctggccagctatacccagcaggaggacaccactgtggctgagcccaaagagttcaagcggatcagcttcccaacagctgcacctcagaaggaagacaaagtttcagctgtgcccattgaggcccccgatgtgtccaaaggcatccccaaggcagccacacctgaagagaaggcagctgcggagtgtgcacaggaagcggagccccccaagtctgaggagagtttcagatctcgagaggctgaggagggccaggaagggcaggatgccatgtccagggccaaagccaactggttgcgagccttcaacaaggtgcgcatgcagctgcaggaggcccgaggagaaggagagatgtccaagtctctgtggttcaaaggcggccctggtggtggccttatcatcattgacagcatgccagacatcaggaagcggaagcccattcccctcgtgagcgacctggctatgtctctggtccagtcacggaaggcgggcatcacctcggccttggcctccagcacgttgaacaatgaagagttgaaaaaccacgtttacaagaagaccctgcaagccttaatctaccccatctcctgcaccacgccgcacaacttcgaggtgtggacggccaccactcccacctactgctacgagtgcgaggggctgctgtggggcatcgcgcggcagggcatgcgctgcaccgagtgcggcgttaagtgccacgagaagtgccaagacctgctcaacgcggactgcctgcagcgggcggctgagaagagttctaagcatggcgctgaagaccgcacgcagaacatcatcatggtgctgaaggaccgcatgaagatccgcgagcgcaacaagcctgagatcttcgagctgatccaggaggtcttcgcggtcaccaagagcgcacacacacagcagatgaaggccgtcaagcagagtgtgctggatggcacatccaagtggtctgccaaaattagcatcacggtggtctgtgcccagggcttgcaggccaaggacaagacaggatccagtgacccttatgtcaccgtccaggttgggaagaccaagaaaaggacaaaaaccatctacgggaaccttaacccagtgtgggaagagaatttccactttgaatgtcacaactcctctgaccggatcaaggtgcgtgtgttggatgaagacgatgacatcaaatcccgtgtgaagcaaaggtttaagagggagtctgatgacttcctagggcagacaatcatcgaggtgcggacgcttagcggcgagatggatgtgtggtacaatctggacaagagaacagacaagtctgctgtgtcgggcgccattcggcttcacatcagtgtggagatcaaaggggaggagaaggtggcaccctaccatgtccagtacacctgtctgcatgagaacctgttccattttgtgacggatgtacagaacaatggcgtggtgaagattcccgatgccaaaggtgacgacgcctggaaggtttactatgatgagactgcccaggagatcgtggatgagtttgccatgcgctatggcgttgaatccatctaccaagccatgacccactttgcctgcctctcctccaagtacatgtgccctggggtacccgctgtcatgagcaccctgcttgccaacatcaacgcctactacgcacacaccaccgcctccaccaacgtgtctgcctccgaccgcttcgctgcctccaatttcgggaaagagcgctttgtgaaacttctggaccagctgcacaactccctgcggattgacctgtccatgtaccggaacaacttcccggccagcagccccgagcggctgcaggatctcaagtccacagtggacctgcttaccagcatcaccttcttccggatgaaggttcaggaactgcagagtccgccacgtgccagtcaggtggtgaaggactgcgtgaaggcgtgcctcaactccacctacgagtacatcttcaacaactgtcatgagctctatggccgggagtaccagacagacccggccaagaagggggaggtccccccggaggagcaaggccctagcatcaagaacctggatttctggtccaagctcatcaccctcatcgtgtctatcattgaggaggataagaactcctacacaccctgcctcaatcagtttccccaggagctgaatgtggggaagatcagtgctgaggtgatgtggagcctgtttgcccaggacatgaagtacgccatggaggaacacgacaagcaccggctgtgtaagagcgcagactacatgaacctgcatttcaaggtcaagtggttgtacaacgagtacgtggctgaactgcccaccttcaaggaccgcgtgccggagtaccctgcgtggtttgagcccttcgtcatccagtggttagatgagaatgaggaggtgtcccgggacttcctgcatggtgcactcgagcgggacaagaaggatgggttccagcagacatcggagcacgccctgttctcttgctcggtagtggacgtcttctcccagctcaaccagagctttgagatcatcaagaagctggagtgtcctgacccccagattgtgggccactacatgcggcgctttgccaagaccattagcaatgtgcttctccagtacgccgacatcgtctccaaggacttcgcttcctactgctccaaggagaaggagaaagtgccctgcatcctcatgaacaacacacagcagctgcgggtgcagctggagaagatgttcgaggcgatgggtgggaaggagctggacgccgaggccagcggaaccctgaaggagctgcaggtgaaactcaacaatgtcctggatgaactcagccacgtgtttgccaccagcttccagccacacatcgaggagtgtgtcagacaaatgggtgacatcctaagccaagtgaagggcacgggcaacgtgcccgccagtgcctgcagcagcgtggcacaggacgcagacaacgtgctacagcccatcatggatcttctggacagcaacctcaccctgtttgccaaaatctgtgagaagacggttctgaagcgggtgctgaaggagctgtggaagctggtgatgaacaccatggagaggaccattgtcctgccgccactcactgaccagacgatgattggtaccctcttgagaaaacatggcaagggcctagaaaagggcagggtgaaactgccaagccactcagacgggacacaaatgatcttcaatgccgccaaggagctgggccagctgtccaaactgaaggatcacatggtgcgagaagaagccaagagcttgaccccgaagcagtgtgccgtggttgaactggccctggacaccatcaagcaatacttccacgcggggggcgtgggcctcaagaagacctttctcgagaaaagcccggaccttcagtccctgcgctacgccctgtcgctctacacacaggccaccgacctgctcatcaaaaccttcgtgcagacgcagtcagcgcaggtccatggtggaaaggggactaggtttacccttagtgaagacgtttgtcctgagatgggctcgggtgtggaagaccctgtaggtgaagtatccgtccacgtggagctgttcacgcatccgggaactggggaacagaaggtcacagtgaaggtggtggccgccaacgacctcaagtggcagacttctggcatcttccgtccgttcattgaggtcaacatcgttggacctcagctcagcgacaagaaacgaaagttcgccaccaaatcgaaaaacaacagctgggcgcccaaatataacgagagcttccagttctccctgagcgccgacgcgggacccgagtgctacgagttgcaggtgtgcgtgaaggactactgcttcgcgcgcgaggaccgcacggtggagctggcggtgctgcagctgcgggagctggctcagcgcgggagcgccgcgtgctggctgccgctcggccgccgcatccacatggacgacacggggctcacagtgctgcgtatcctgtcgcagcgcagcaatgacgaggtggccaaggagttcgtcaagctcaagtccgacacgcgctcggccgaggagggcggtgccgcgcctgcgccctagcgcgcgttttggcggcggggcggggcctgggaagggatgaggtcccgccttccgtaggccaccgcctctccagaggccacgcccctccacctcagtggccttggctggggaggccctgccccctgcccctggaaaagccatagagggtccggtgcccagggcatggactgggcagggctgcctgggaggctgggtcgcagcctctggtgtctgcaaaatacagggcgggatggactctcaaaagcacaccggccctcggcgcacagctggggctgcgggcacccctctccgcggaccccgccctcagcagcgggcccactggcagctggcgaccccctgctcgtgtcacacagggcgggctgagctc

SEQ ID NO: 2158 - DNA, 3770 bp, Rattus norvegicus
  Genbank Accession No. NM_022863
tgaggccggcgatggactccccaagtgcaggatacacctttgagtaccttattgaaacattaaatggcagttcacagaagaagttcttcaatgtacctaaacttggaggcaccaagtatgatattctgccttactcaatacgggtcctattggaagctgctgtacgaaattgtgatggatttttaatgaaaaaggaagatgttataaatattttggactggaaaaccaaacaaagcaatgttgaagtgccctttttccccgcccgtgttgttcttcaagatttcactggaataccggcaatggtggattttgctgctatgagggaggcaatgaaaactcttggaggtgatcctaagaaagtccaccctgcctgtccaacagatctcacagttgaccactctttacagattgacttcagtaaatgtgcaatacagaatgcaccaaatcctggaggtggtgacctacagaaagcaggaaagctctctccacttaaagtacagcctaagaagcttccatgtcgaggccagactacctgccggggatcgtgtgattctggagaactaagccgaaactcaggaacattttcttcgcagattgagaatacgcctgtcctgtgtccctttcatttgcaaccagtgcctgaacctgagacggtgttaaaaaatcaagaagtagaatttggcagaaatcgagagaggcttcaatttttcaagtggagctcaggagcttttaagaatgtggcagtcatccctcctggaactggaatggctcatcaagtgaacttagaacatttgtcgagagtagtgtttgaagaagccgacctgctcttcccagacagcgtaattggcacagattctcatataaccatggtgaatggattgggaattcttgggtggggagttggaggcattgagacagaggcagttatgcttggcctgccagttactcttactttaccagaggtggttggatgtgagctaactgggtcatccaatgcttttgttacatccatagatattgtcctaggcattacaaagcacctcaggcaagtaggcgtggctggaaagtttgttgagttctttggaagtggagtttcacaattatctattgtcgatagaactactatagcaaacatgtgtcccgagtatggtgctatcctcagctttttccctgttgacaatgtgacactacgacatttagaacatacaggttttgacaaaaccaaacttgagtcaatggaagaataccttaaagctgtgaaattgtttcgaaatgatgagaattcttcagaacctgaatattctcaggtgatacagattaatctgaattcaatagttgcatctgtcagtggtccaaaaaggcctcaggatagagttgctgtaacagatatgaaaagtgattttcaggcttgcttaaatgaaaaggttggatttaaaggcttccaagttgcagcagaaaaacaaagtgatactgtctcagttcgttatgatggaagtgagtataagctgtcccatgggtccgtggtcattgctgcggttatcagctgtaccaataactgcaatccatcagtgatgctcgctgcaggtcttttggctaaaaaggctgttgaaactggtctacgagttaaaccttatataagaacaagtttgtctccaggcagtgggatggttacacattacctcagttcaagtggagtgttaccctaccttagcaagctagggtttgaaatagttggctatggatgttcaacgtgtgtaggaaatacagcacctttatcagaagcaattttgaatgcagtaaaacagggtgatttggctacctgtggagttttatctggaaacaaaaatttcgaaggtcgtctttgtgattgtgtccgtgctaattatctcgcctctccacccttagtggtggcttacgccatagcaggcacagtgaatatagatttccagacagagccattaggtactgactctacaggcaagaacatttacctgcatgacatttggcctagtcgagaagaagttcatcagatagaagaagaacatgttattttgtccatgtttaaagcactgaaagagaaagtagagatgggaaataaacggtggaattccttagacgctccagattcagtgttgtttccatgggatgttaagtctacttacatcagatgcccttcattttttgataaacttaccaaagaaccagctgcatcccagcctattgaaaatgcccatgtcctgttgtacttgggagactctgtcactacagaccacatatcacctgctggaagcattgctaggagcagagctgctgctaagtacttgacaaacagaggccttactccccgagagttcaactcttatggagctcgaagaggtaatgatgctgtgatgacaagaggcacgtttgcaaacatcaagctttttaataagtttattgggaagccagctcccaaaacaattcattttccatcaggacagacgctcgatgtatttgaagctgcagaattataccaaaaagaaggtatcccactgataattttagcaggaaaaaaatatggttcaggaaattcaagagactgggctgcgaaaggaccctatttgctgggtgtaaaggctgttttggctgaaagctatgaaaagatacacaaagatcatttgattggaattggtatagcaccacttgagttcctcccaggagaaaatgcagattccttgggcctctccggcagagaagtattttctttatcatttcctgaagaactctttcctggaattacgttaaatataaagacgagcactggcaaagagttcagcgtgattgcagcatttgaaaatgatgtggagataactttgtacaaacatggaggattgttaaactttgtggctcgaaaattcttatagtatctactccccatggtatctttcatggctggtaactgcaaagccttcttctgtgctggacccaggaatcattgccatggaactgcagatgatttcagtatacttctctcctccatggatgtaaatgataacgaatcaacgtagtgactaaaatgaaatcttgattttaaataatatacgaatggtgctattaacattgctaaaatcaacgtgtgaaggtgtgttgtggaagagacctgtaagtatggggggtatattttatgagaacattttgtaaataaagacagaatttgaacttgtgttgaagattcatatgaatagccgttctaaagctgtttgttttgttttgcaccttaaaactggactactgtttgttggtttaagaatagcaagttgatttagaagaagccagactagatcctaaaattatggaaatgggtacctgatttagaaatgaatttttaaatgtttttctttccagaattgaattggacacaattggcatttccagtttgtaatgtaagtcaggtttggccttagtctcaatacatctgcaaggcatagaacctgccccagatcacagtccctctgaccagccaaaatgtcctccatgtctgcagataaatgactgtaaaatacagctgattgtgtggtaccgtgtattagtaagaatatatttcctgtggtatagccctgtaattttttcagtaacttgccactatgacccactcacaagcccaaatacggtgtattaatttggactagattttgctcattttacatgactgtaactcctgtaacctcaattaggaatcactagctgacattccacactccttttatgactgctggaaacaattgagtcaa

SEQ ID NO: 2159 - DNA, 861 bp, Rattus norvegicus
  Genbank Accession No. NM_022867
ggcacgagccaggacccccgcgcgccatgccgtccgagaagaccttcaaacagcgccggagcttcgaacaaagagtggaagatgtccggctcatccgggagcagcaccccaccaagatcccagtgattatagagcgatacaagggtgagaagcagctgcccgtcctggacaagaccaagttccttgtacctgatcacgtgaatatgagcgaactcatcaagataattagaaggcgcctgcagctcaatgctaaccaagccttcttcctcctggtgaatgggcacagcatggtgagtgtgtccacacccatctctgaagtgtacgagagcgagagagatgaagacggcttcctgtacatggtctatgcctcccaggagacgttcgggacagcactggctgttacatacatgtcagctctgaaggcaacagcaacaggaagagagccatgcttgtgacagacatacagccacttccaactaaagcaagcctctgcttcctgctacctgcatggagcccactgtgacactcagaccatccccggtcactcactcgtgtctgagaatctcagtgagagctgcctctgtcacggaccggaagccaacacagccacctctcgacctgctccccacagcacccaccctccctgcatgcaagctgtccctgctaacccccaatgttatgttacactgtgtaaatccccactgctgccgtgtgtgggttgtgtacgtcgtcatgtccctggtttataactatggtgcggtcgggaaggattcctgtaatgctgctctaaggatctggctcaggcagccattgtaggacacctgtactctgatgcactaagtccaataaaggcacaactgg

SEQ ID NO: 2160 - DNA, 3609 bp, Rattus norvegicus
  Genbank Accession No. NM_022869
gttcttcagtcgtaccgcgtgcgcaacggtagtgacgcgtttaacccggagtatggcggataccggcttgcgccgcgtggttcccagcgacctttatccccttgtgctcggctttctgcgagataaccagctctcagaggtggccagtaaatttgcaaaagcgacaggcgctacacagcaggacgccaatgcctcttccctcttggacatttatagcttttggctcaagtccaccaaagccccgaaggtgaaactgcagtcaaatggaccagtggccaaaaaggctaagaaagagacttcatccagtgacagcagtgaggacagcagtgaggaagaggacaaagcccaagttcccacacagaaggctgccgcccctgccaagcgagccagtttgcctcagcatgctgggaaagcagcagccaaagcttcagagagcagcagtagtgaagagtccagtgaggaagaggaggagaaggacaaaaagaaaaagcctgtccagcagaaagcagttaagccccaagccaaggcagtcagacctcctccgaagaaggcagagagctctgagtccgagtctgactcaagctcagaggatgaagcaccacagacccagaagccaaaggcagctgctacggcagctaaagccccgactaaagcccagactaaagccccagccaaaccaggtccaccagcgaaagcacagcctaaagcagccaatggcaaagcaggcagcagcagcagcagtagcagcagcagtagcagtgatgactcagaggaagagaagaaggcagctgcacctctcaagaagactgcacctaaaaagcaagtcgtggccaaggcaccagtaaaagtaactgctgcccccacccaaaagagttctagcagtgaggactcttccagtgaagaggaagaggaacagaaaaaacccatgaagaaaaaagcaggtccctacagttcagttccaccaccttctgtttctttatccaaaaagtccgtgggagcccagtctccaaagaaagcggccgcgcaaacacagcctgcagacagcagtgcagacagcagcgaggagtctgattcaagttctgaggaagagaagaaaactccagctaagacagtcgtctccaagacacccgccaaaccagctccagtgaagaaaaaggccgagagctcttcagacagctcagattctgacagttctgaggatgaagctcctgccaagccagtcagtgccaccaagagtcccttaagcaagccagctgtcactcctaagccgcctgctgcaaaggcagtggcaactcctaagcagcctgcgggcagtggccagaaacctcagagcagaaaggctgacagcagctccagcgaggaggagagcagctccagtgaggaagaggccaccaagaaaagtgtgacaacccctaaggccagggtgaccgccaaagcagcaccctctctacctgccaaacaggctcctcgggctggtggagacagcagctccgactcagagagttccagcagtgaggaggagaagaagacgccgcctaaaccccccgctaagaagaaggcagcaggtgcagccgttcccaaacccacccctgtgaagaaagcagcagccgagagcagcagcagcagcagctcctccgaagattccagtgaagaagagaaaaagaagcccaagagcaaagctactcccaaaccacaggcaggaaaggccaatggcgttccagcttctcagaacggaaaagcaggcaaggaaagtgaggaggaagaggaagacacagaacagaacaaaaaggcagccgggaccaagccaggttcaggcaagaaacggaagcacaatgagacagcagatgaagcagcaactcctcaatctaagaaagttaagctgcagacccctaatacgtttccaaaaaggaagaagggagagaaaagggcatcttcccctttccgaagggtcagggaggaggagattgaggtggactctcgagtagcagacaattccttcgatgccaagcgaggtgcagctggagactggggtgagcgagccaatcaggttctgaagttcaccaaaggaaagtccttccggcacgaaaaaacaaagaagaagcgaggcagctaccggggaggctccatctctgtccaggtcaattccgtcaagtttgacagcgagtgacctgtgtcatctttagcaaaggaagggtgactttgggaggctggcactcacctccaatggacccagaaactcagtgttattaggagagagttgtggcacggacagtttgaagcaggttctttgacactgcagtctatagtccttccatgctcctgcttctggacaggtttgtttttgagcgttgattgtcaaagacaaaaagtttttttgtttgttttgttttattttttaagaaatccatttggttgtcagctgccttcctgttctgttggtcttcatactgagaaattgtatattttatattaaatcatgtcatacagatttttgttgtgattttcagagatgagttccacagattaaagtctttgcctaaggcaatgcacagagtcacatggaggattctgtttatgtgagtgcgcagacccacatttgatcccacccctcaaagccccggtgggccctgacataagtcttgtgatgtttgactgctaagcatgccctgtgctcatcttcatccattgggcctgacaccgaagcttcccgaagccggcgtggatctgccaactttggggataaaattgcagttcttggtacaatttcctactgaactgacaggcaggattctcgatgtgagtgcgatgcaacggtttttgttttgttctcagtagctattagtgctacgtgtttacagtgtgttctagttttaatttcgaagtaagcttttctgacactgagaggcatttgcaacaacttgactcttaccgctgttgtatataagctcatgaatatatttgattcttgttaacatcatcaagagcagaatggtaaactcctgcatggttgaggcactggtcaaggaagtggagatgacctacctgagcctctgggtgaagtaggtacggtggatagatcctgggcacctgcagtgaggagcaggcgaaggacagtgaggctgggagaggtctgggcaggaccgttctgtctggatccctcccctcaaagggatcacatgggagtggttatgtcttatttaagttggtcccctggattgattattggtaccttaactatatgatgttactgatacaggctaaccagggggggctgggaggcatatctgggtgatagtggcgcttacctaccattcaaggacagagtgtgatctccatcaaggcaggaagtgaatgagcagagatccctgggccaagggagtaaattataaagccgtaagatttgaccattggcagagctcagccagagtgagggaagggagaagagcaccctggctaacctggtgagaacagacacggagcctccctggtttggtttccatggtcacctggtaacctgctaaaagtgggtgcctgtggcagctccttgaggaagtctgcatggtcaaagttctgtgtcttactacaaaacaataaaatggatggtccctg

SEQ ID NO: 2161 - DNA, 1610 bp, Rattus norvegicus
  Genbank Accession No. NM_022934
ggccgggcggaactttccagaacgctcggtgggtggtagaggagcagcgtctggccgagctgcgctgtgctacgctcctctttccgctctccggcgccggcccgctcaccggctgtaaaaaatggtgaaagaaactacttactatgatgttctgggggtcaaacccaatgccacccaggaagaattgaaaaaggcatatagaaaattggccttgaagtaccaccctgataaaaatccaaatgaaggagaaaagtttaaacagatttctcaagcttatgaagttcttgctgattccaagaaaagggaactatatgataaagggggcgagcaggcgattaaggagggcggagcaggtggaggttttggctcgcccatggatatctttgatatgttctttggaggaggaggaaggatgcaaagagaaaggagaggtaaaaatgtcgtgcatcagctctcagtgaccttagaagacttatataatggtgcaacaaggaaactggctctgcaaaaaaatgtgatttgtgacaaatgtgaaggccgaggtggtaagaaaggagcagtagagtgctgtcccaactgccgggggactggcatgcagatcaggattcatcagattggaccaggaatggttcagcaaattcagtcagtgtgcatggagtgccagggtcatggagaacgcatcagtcctaaagacagatgtaaaagctgcaatggaagaaagatagttcgagagaagaaaattttagaagttcatattgataaaggcatgaaagatggtcagaagataacattccacggtgaaggagaccaagaaccaggactggagccaggagatattatcattgtgttagatcagaaggaccatgctgtttttacaaggcgaggagaagaccttttcatgtgtatggacatacagctggttgaagcattgtgtggcttccaaaagccaatatctactcttgacaaccgaaccatagtcatcacctctcatccaggtcagattgtcaagcatggggatataaaatgtgtgctaaatgaaggtatgccaatataccgtcggccatatgaaaagggacgtctaatcattgagtttaaggtaaactttcctgaaaatggctttctctctcctgataaactctctttgctggaaaaactccttcctgaaaggaaggaagtagaagagactgatgaaatggatcaggtagaactggtggactttgatccaaatcaggaaagacggcgtcattataatggagaagcgtatgaggatgatgagcatcaccccagaggtggcgttcagtgtcagacctcttaatgggccagtcactctttgaccttgtgtatgcagtagtgaatgtgggaaggactgtaatcataatatgctcactacttggctgttgtttttgttttaatattcaactatagtagtgttttaaaagttaaatgaagaataaacacaaatataaaagctctgactttgccctgtatgtatgatgactttaatgttcaagatgaaaatgaatacttgtaaaaaactagtttaaaaaatgccctagcatctgttaggccatatcttgtgtaactgataatagcgtgtacattagactgac

SEQ ID NO: 2162 - DNA, 1992 bp, Rattus norvegicus
  Genbank Accession No. NM_022936
cttcttgtctttgtcagcttggcgctgcagcccgggccatcatggcgctgcgtgtggccgcgttcgaccttgacggagtgctggccctcccctctatagccggggttctgcgccacaccgaggaggccctggcgctgcccagagacttcctacttggcgctttccagatgaaattcccagagggacccactgagcaactcatgaaaggaaagatcacattttcccagtgggtaccactcatggatgaaagctgcaggaagtcctccaaagcctgtggagccagtctacctgagaatttctccataagtgaaatattcagccaagccatggcagcaagaagcatcaaccgccccatgcttcaggcagctgctgctctcaaaaagaaaggattcacaacgtgcattgtcaccaacaactggctggacgacagtgacaagagagacatcctggcccagatgatgtgtgagctgagccaacactttgacttcctcatagagtcctgtcaggtcgggatgatcaagcctgagcctcagatctacaagtttgtactggacaccctgaaggcaaaacccaatgaggttgttttcctagatgactttggaagtaatctgaagccagcccgtgacatggggatggttaccatcctggtccgcgacacagcctcggctttgagagaactggagaaagtcacagggacacagtttcctgaggcacctctgccagtcccgtgcagtccaaatgatgtcagccatgggtatgtgacagtgaagccagggatccgtctgcactttgtggagatgggctctggccctgctatatgcctctgtcatgggtttcctgagagctggttttcttggaggtaccagatccctgctctggcccaggcgggctttcgtgttctagctatagacatgaaaggctatggagactcatcttctcctccagaaatagaagaatatgctatggaattgctgtgtgaggagatggtgacattcctgaataaactgggaatccctcaagcagtgttcattggccatgactgggctggtgtgctggtgtggaatatggctctcttccaccctgagagagtgagggctgtggccagtttgaacactccattaatgccaccaaatcctgaggtgtcccccatggaagttatcagatcgatcccagttttcaactatcagctgtactttcaagagccaggagtggctgaggctgaactggaaaagaacatgagtcggactttcaaaagcttcttccgaaccagtgatgatatgggtctcctcactgtgaataaagccactgaaatggggggaatccttgtgggaactccagaagatcccaaggtcagcaaaattactactgaggaggaaatagagtattacatacagcagttcaagaagtctggcttcagaggccctctaaactggtatcgaaacacagaaagaaactggaagtggagctgtaaggcgttgggaaggaagatcttggtccctgccctgatggtcacagctgagaaggacattgtactccgtcctgaaatgtccaagaacatggaaaactggatccctttcctgaaaaggggacacatcgaagactgtggtcactggacacagatagagaaaccggcagaggtgaaccagattctcatcaagtggctgaagactgaaatccagaacccatcggtgacctccaagatttagccagtggcgtgtcctctgctggggacacattttcatttctggacgtggccttatccacagccagcagcatcgttcttttgccagcagtgattttctttaaatgaaaatgatcagatgtgatgtaattttagatcaggaagaaagtggtgtgtctgattcttttgaggatgactgtatcaccaaaggagagatcacaccccaatagggaggcatggggcagcccagtttgtacctttgtagccaaacccaagcctgctctttctgaagcagctgatcagagagtagg

SEQ ID NO: 2163 - DNA, 819 bp, Rattus norvegicus
  Genbank Accession No. NM_022939
atgtcctacggtcccttagacatgtatcggaatccgggccgtcggagcctccgggacttcagcagcatcatccagacgtgcagcggcaacatccagcggatcagccaagccactgctcagataaagaatttgatgagccaacttggaactaagcaggactcaagcaaactccaggaaaatttgcaacagttccagcactccacaaatcagcttgccaaggagacaaatgagttgctgaaggagttagggtccttgcccctacccttgtctgcatcagagcagcgccaacagaagcttcagaaggagcggctcatgaatgacttctcgtcggccttgaacaatttccaggttgtgcagagaaaggtatctgagaaggagaaagaaagcatcgcgagagcacgggctggatcccgtctttctgcagaagacaggcaaagagaagagcagctcgtctcatttgacagccatgaggagtggaaccagatgcagagccaggaggaagaggcggccatcactgagcaagacctggaacttattaaagagagggaaacggcgattcagcagctggaggctgacattttggatgtcaatcagatctttaaagacttagctatgatgatccacgaccaaggtgatctgattgatagcatagaagccaatgtggaaagctcagaggtgcatgtggaaagagcctctgatcagctacagagagctgcttactatcagaaaaaatctcgcaagaagatgtgtatcctcgtgcttgtcctctcagtgattgttacagtcttggtagttgttatctgggttgcttctaagtga

SEQ ID NO: 2164 - DNA, 2138 bp, Rattus norvegicus
  Genbank Accession No. NM_022947
ggctagcacgggggccggcaccagcaggttttagaggcaggtgtcatgatgttgtccgcggtgttgaggagaaccgcgccagcgcctcggctcttcctagggttaatcaaatctccatctcttcaaagccggggaggtgcttacaaccgtagcgtaatcaccggagaccgcggggagccgcagcggctgagaactgccgcctgggtgcgccctggagcatcttctgtcttgttccccggacggggggcagccaccggggggcgccgtggagaacgcaccgagatcccatacctgactgccgcctcgtctggacgcggtcctagcccggaagaaacactcccaggacaagacagctggaatggggtccccaacaaggcgggattgggcatgtgggccttggccatggcgctggtggttcagtgctacaacaagaatccatctaacaaggatgcagctttgatggaagctgcccgagccaataatgtgcaggaagtcagaaggctgttatcagaaggtgcagatgtcaacgcaaggcacaaacttggctggacagcattgatggtggcagccatcagccacaatgagagtgtggtacaggttctccttgctgctggagctgacccaaaccttggggacgacttcagcagtgtctacaagactgccaatgaacagggagtccattctttggaagtcctagtcactcgagaggatgacttcaacaaccgactaaaccaccgtgcaagtttcaaaggctgcacagccctgcactatgctgtcctggccgacgactacagcatcgtcaaggaactactgggtggaggagccaacccccttcagaggaatgagatgggacacacacccctggattatgcccgggaaggggaggttatgaagcttctgaaaacttctgaaaccaagtacatggagaagcagaggaagcgtgaggcagaagaacggcgccgcttcccactggagcagcgactggagcagcacatcattggccaggagagtgccattgctaccgttggtgctgcgatccggaggaaggagaatggctggtacgatgaggagcaccctctagtcttcctcttcttgggatcatctggaatagggaaaactgagctggccaagcagacagcaaagtatatgcacaaagatgccaaaaagggcttcatccggctcgacatgtctgagttccaggagcgacatgaggtagccaagtttatcggttctccgccaggctacatcggccatgaagaaggtggccaactgaccaagaaactgaaacagtgcccaaatgcagtagttctctttgacgaggtggacaaggcccatccagatgtgctcaccatcatgctgcagctgtttgatgagggccgcctgacagatggcaaggggaagaccattgactgcaaggatgccatcttcatcatgacttccaatgtagccagtgatgagatcgcccagcatgcattgcaactgagacaggaagctttggagatgagccgaaatcgaatagctgaaaaccttggggatgtccagattagtgacaagatcaccatctcaaagaacttcaaagagaatatgatccgacccatcctgaaagctcacttccggagagacgagtttctgggaaggatcaatgagatcgtctacttcctccctttctgccactcggagctcatccagctggtcaacaaggaactgaacttctgggccaagagagccaagcagagacacaacatcacactactgtgggaccgcgaggtggcagacgtgttggttgatggctacaacgtccagtatggtgcccgctccattaagcatgaggtagagcgccgtgtggtaaaccagctggcggcagcctatgagcaggacctgctaccagggggctgcaccctgcgtatcactgtggaggactcagacaagcagctcctcaagagccctgagctgccctcgccccaggctgaaaagcgtccgcctacactgcgactggagatcattgataaggacagcaagacccacaaactggacatccaggcaccactccaccccgagaaggtgtgctacaccatctagcatccacctgcctgtgccctgaacatctaataaaggccccttgctgtggcatggcaacc

SEQ ID NO: 2165 - DNA, 2699 bp, Rattus norvegicus
  Genbank Accession No. NM_022948
tcgggtctggtctcaacagcctggtctgggggagtcactccagatgacatccactgtcccggaactctgccaagaggggggtgggtcaggcgaaccagtttagggagcccccgcccttccctgctgctcagcgtcacgcgtgacgtccgggtgatggctgggaggaaagcggagagctgtgaggaaggcgggtctgagagctgctagaggctgtaaatccccggaaagcaagatgggcgacttgcccttaaatatcaacatccaggaacctcgatgggaccaaagcacattcctaggcagagcccggcacttcttcacagttactgatccccgaaatctcctgctgtccgggaaacagttggaagcttctcggaacatcgtgcagaattacagggctggtgtggtaactcctgggctcactgaggaccagctatggagagccaaatacgtgtatgactcagcattccacccggacacaggggagaaggtggtcttgattggtcgcatgtcggcccaggtgcccatgaacatgaccattactggctgcatgctcaccttctacaggaagactccaactgtggtgttctggcagtgggtgaatcagtccttcaatgctattgtgaattactctaatcgcagtggagacgctcctatcactgtgcagcagctgggaacggcctatgtgagtgccaccactggggctgtggctactgctctgggactcaagtctctcaccaagcacctacccccactagtgggtcgattcgtaccctttgcagctgtggctgccgccaactgcatcaacatccccctgatgaggcagagggagctgcaggtgggcatcccagtgactgatgaagctggtcagagacttggccactcggtgactgctgccaaacagggcatcttccaggtggtggtatcgagaatcggcatggcgatccccgccatggccattcccccggtgatcatgaacactctggagaagaaagacttcctcaagcgccgcccctggctgggggcccccctgcaggtgggactggtaggcttctgcttggtatttgccacacctctgtgctgcgctctttttccccagagaagctctatacatgtgaccaggctggagccggagctgagagctcagatccaagcacaaaaacccagcatcgatgtggtttactacaacaaggggctttgaggggaatcggcctctgtccctgtccttacctccttaggctgcttctttggtgccacttctcaatgctaccacctgtttaatcttccgggtactgggcaggggggcttgatgtggggagcagccactgagaccagcaaccttagactgggggaggcacccctataagcctcttctctcctctctggtttcaaagagcaagtcacaaagcccatccctcctgtgtctgtgtgcgtgcgtgcagacatacctaggcagtgcatggaactgttcgttcatttgctcctgaatgctaaggcagaagtgctgttctaggatgtcctgatgtttgtcttctctctcggtctcctgcccacctcacagcaagccaggtgataggcgagaatcctttccctaagctattcctctggccaagtcatttctgatagcatcttagccttctgaccccaagataagcgccaggatcccagaacacagactgaaggacatctgcagatcttaacccttccagttttgaatagctggctctgaaagctggttcaggagctgggctggcagaggaagcagggtgggatcagggaagcagggggctcatacttgctggactccacatcctgggatggctccactcctctcttctcttcctatggaacatgaggatgtctctgtagcctgcagtgcccctaccctgcttttagagatagtcttgggcattcttggtctgttctgatgactcatgtcatgactcagaaagaaatcccacaatcccaattccttccccaattagaaagccacacaggcagagcaagcattctcttcaggaactgccaccccctgtacccacttatagggggaccggtgtgggaacggtgcttaaacacaggcctcaagcgtacaatatcaagacaggtaattctgtgtttcattgactcctcttagacacacccacctcagctccttcctttccatctaccccgtctctgaaagaacccagggcttcacaatgctaggcaagtgctctaccactgagctacatccccagtgccccctcttccttccttcctgtctctttctttcttttttgtttttgtttttcaaatatggtttctctatgtagccctggctgtcctggaactcagagatctgattgcctaagacagtgagttctgggattaaaggcatataccaccattgccagcagcccttcttgttcctaagacatggatggccctgtgctccctctgcccttcaaaaagaggagggacccaggccttcatagctggaccaaatggaagatgggtttaggaatggcatgagtggtaatgactccagtgtgtagaattatatctgcactctaaatccatgacctctagctaaaaggcgaatggggtccccagtgatatccacggagaccactttcactcaccccctcctccagtgacaacaggtgtcatgtcatggtgtcaataaactgcagtcctgtctaaaaaaaaaaaaaaaaaaa

SEQ ID NO: 2166 - DNA, 715 bp, Rattus norvegicus
  Genbank Accession No. NM_022949
tctcgctgagcccgccaacatggtgttcaggcgtttcgtggaggttggccgagtggcctacatctcctttgggccccatgctggaaagctggtcgcaatcgtagatgttattgatcaaaacagggctttagtggatggaccctgcacccgggtgaggagacaggccatgcctttcaaatgcatgcagctcactgacttcatcctcaagttcccacacagtgcgcgccagaagtatgtacggaaagcttgggagaaggcagacatcaatacaaagtgggccgccacacgatgggccaagaaaattgatgccagagaaaggaaagccaagatgacagattttgatcggttcaaagtcatgaaggcaaagaaaatgaggaacagaataatcaagactgaagtgaagaaactccagagagctgctctcctgaaagcttctcctaaaaaagctgctgttgctaaggctgccattgcggccgctgcagcagctaaagccaaggtcccagccaagaaggcaacaggaccaggccagaaggccgcagcgcagaaggcctctgcacagaaggctgcaggccagaaggcagcgccccctgctaaaggtcagaagggtcagaagaccccggcccagaaggcacctgctccaaaggcagctggcaagaaagcatgaggaggctacacaaagaataaaggttctttttgactgaaaaaaaaaaaaaaa

SEQ ID NO: 2167 - DNA, 4950 bp, Rattus norvegicus
  Genbank Accession No. NM_022953
ctgggagcatctaggtgctactcgagccgcaagggcgcatcgtacgatccccccggctcttcggtccctcggtggggatagcacctggagatagccccggacggggatggtcagcggctgcggccgtctgacacacgagcgggacacggcgagggcaccatggcgctaacgccccagcgcgggtcctcttcggggttgagccgaccagagctgtggctgctgctatgggcagccgcgtggcgcctgggggccacggcgtgccccgccctctgcacctgcaccggcactacagtggactgccacggcacgggtttgcaggccatccccaagaacatcccacggaacaccgagcgcctggaactcaatggtaacaatatcactcggatccataagaatgactttgctgggctcaagcagcttcgagtgttgcagctgatggagaaccagattggagctgtggaacggggagcttttgatgacatgaaggagttggagcggctacgactgaaccgcaaccagctgcaagtgttgcctgaactactgttccagaacaaccaggctctgtccagactggacctgagtgagaattctctccaggctgtgcccagaaaggctttccgaggagccacagacctcaaaaatctacagctggacaagaaccagatcagctgcatcgaggaaggggccttccgtgccctacggggactggaggttctgaccctgaacaacaacaacatcaccaccatccctgtgtccagtttcaaccatatgcccaagcttcggaccttccggctgcactccaaccacctgttctgtgactgtcacctggcctggctctcgcagtggctgagacagaggcccaccatcgggctcttcacccagtgctctgggcccgccagccttcggggcctcaatgtggcagaggtgcaaaagagtgagttcagctgctcaggccagggggaggctgcacaagtacctgcctgcaccctctcatccggttcctgcccagccatgtgcagctgtagcaatggcatcgtggactgccgtggcaaaggcctcactgccatccctgctaaccttccggagacgatgaccgagatccgcctggagctgaacggtatcaaatccatcccaccaggagccttctctccctacagaaagctgcgcaggatagacctgagtaacaaccagattgctgagattgcacccgatgccttccaaggcctccgctccttgaattccctggtcctctatggcaacaagatcacagacttgccccgaggtgtatttggaggcctgtacaccctccagctgctgcttctgaatgccaacaagatcaactgcatccggcctgatgccttccaggacctgcagaacctctctctgctctccctatatgacaacaagatccagagtctcgccaagggcaccttcacctccctgcgggccatccagacactgcatctggcccagaaccctttcatctgtgactgtaacctcaagtggctggcagacttcttacgtaccaaccccattgagacaactggggcccgctgtgccagcccccggcgccttgccaacaagcgtatcgggcagatcaaaagcaagaagttccggtgctcagccaaagagcagtacttcattccagggacggaggattaccacctgaacagcgagtgtacgagtgacgtggcctgtccccacaagtgccgctgtgaggccagtgtggtggagtgctctggcctgaagctctctaagatccctgagcgaatcccccagtccacgactgagctacgactgaacaacaatgagatttcaatcctagaggccactgggttgtttaagaagctctcacatctgaagaaaataaacctgagcaacaacaaggtgtcagagattgaagacgggacgtttgaaggcgccacctccgtcagcgagctgcacctgaccgccaaccagctggagtctgtcagaagcggcatgttccggggtctagatggcttgcggaccctgatgctgaggaacaaccgtatcagctgcatccacaatgacagcttcactgggctgcgtaacgtgcggctcctgtctctttacgacaaccacatcaccaccatctcccctggagccttcgacaccctccaggccctgtccacactaaacctcctggccaacccattcaactgcaactgccagttggcctggctgggggactggcttcggaagaggaaaattgtgacagggaaccctcgctgtcagaacccagacttcctgcggcagattcctctgcaagatgtggccttccctgacttcaggtgtgaggaaggccaggaggaggtgggctgcctgccccgcccacagtgcccccaagagtgcgcctgcctggacaccgtggtccggtgtagcaacaagcacctccaggctctgcccaagggcatccccaagaatgtcacagaactctacttggatgggaaccagttcacactggttccgggacagctgtctaccttcaagtatctgcagcttgtcgacctgagcaacaacaagatcagctccttaagcaactcttccttcaccaacatgagtcagctgaccacactgatcctcagctacaacgccctccagtgcatcccccctctggccttccaaggacttcgttcactgcgcttgctgtctttgcatggcaatgatgtctccaccctccaagagggaatctttgcagacgtgacgtctctgtctcacctggccattggtgccaaccccctgtactgcgactgccacctccgatggctctccagctgggtgaagactggctacaaggaacctggcattgcccgctgtgctggacccccagagatggagggcaaactgttgctcaccacacctgccaagaagtttgaatgccaaggtccccccagcctggcggttcaggccaagtgtgatccctgcttgtccagcccatgccagaatcagggcacttgtcacaatgaccctcttgaggtatacaggtgtacctgccccagtggctacaagggccgaaactgtgaggtgtctctggacagctgttccagcaacccatgtggaaatgggggaacctgccatgcccaggagggcgaggatgctggcttcacgtgctcctgtccttccggctttgaagggctgacgtgtggaatgaacacagatgattgtgtgaagcacgactgtgtcaatgggggtgtctgtgtggatggcatagggaattacacatgtcagtgccccctgcagtacacaggaagggcctgtgaacagctagtggacttctgctctccggatctgaacccatgtcagcatgaggcccaatgtgttggcaccccagaggggcccaggtgtgagtgtgtgccaggctacacgggtgacaattgcagcaaaaaccaggacgactgcaaggaccaccagtgtcagaacggggctcagtgtgtggatgagatcaacagctacgcctgtctctgtgctgagggctacagcggacagctctgtgagatcccacctgcccccaggaactcctgtgaagggactgagtgccagaatggagccaactgtgtagaccagggcagccggcccgtatgccagtgcctaccaggctttggaggtcccgaatgtgagaagttgctcagtgtcaactttgtggaccgggacacttacctgcagttcactgacctgcagaactggcctcgggccaacatcactcttcaggtctccacagcagaggacaatgggatcctcctctacaatggggataatgaccacattgcagttgagctgtaccagggccatgtccgtgttagctacgacccaggcagctaccccagctctgctatctacagtgctgaaacaatcaacgatgggcagttccacacagttgagctggtgacctttgaccagatggtgaacctctccatcgatggtggcagccccatgaccatggacaactttggaaagcactacacactcaacagtgaggcccccctctatgtgggagggatgcccgtggatgtgaactcagctgccttccgcctgtggcagatcctcaatggcaccagcttccacggttgcatccggaatctatacatcaacaacgaactgcaggacttcaccaagacacagatgaagccgggcgtggtgcccggctgcgagccctgccgaaaactctactgtctacatggcatttgccagcccaacgccaccccagggcccgtgtgccactgcgaggctggctgggggggcctgcactgtgaccagccagtggacggcccctgccatggccacaagtgtgtccatgggaaatgcgtgcccctcgatgcacttgcctacagctgccaatgccaggatggatactcgggggctctgtgcaaccaggtcggggctgtggcagagccctgtgggggcttacagtgcctgcatggtcactgccaggcctcggccaccagaggggcacactgtgtgtgcagcccaggtttttcaggcgagctgtgtgagcaagagtccgagtgccggggggaccctgtccgggactttcaccgggtccagaggggctatgccatctgccagaccacgcgcccactgtcatgggtggaatgccggggcgcgtgcccgggccagggctgctgccagggcctgcggctgaagcggaggaagctcaccttcgagtgcagcgatgggacctcgtttgctgaggaggtggagaagcccaccaagtgcggctgtgccccgtgtgcgtaacgtgcgggtggcacactagcagctgggctggggcgggcatcaccaggatagcgcttgggtcctggtgggcgcggggacactgagctgcctttccagcggactgcactgccagggcagaggagcaaggcccgggttgccaagccctctcccaaagtgccttgcacagataggcgcttaataaatatttgttgaatg

SEQ ID NO: 2168 - DNA, 3269 bp, Rattus norvegicus
  Genbank Accession No. NM_022961
ggacaggattgacagattgatagctctttctcgattccgtgggtggtggtgcatggccgttcttagatggcggctcacctgtcatacgggcgagtgaacctgaacgtgctgcgcgaggcggtgcgtcgggagctgcgcgagtttctggacaagtgcgctgggagcaaggcaatagtgtgggatgaatacttaacaggaccgtttggactgattgcacagtactcactactaaaggaacatgaagtggaaaaaatgttcaccctcaaaggaagtcgtttgccagcggctgatgtcaagaatatcatttttttggtcagacccaggctagaattaatggatatgattgccgagaacgtactcagtgaggacaggcgtggccctaccagggatttccatattttatttgtgcctcgtcggagcctactgtgtgagcaaaggctgaaggacctgggtgtgttgggatcctttatttatcgagaggagtacagtttagatctcattccatttgatggggacctcttatccatggagtcagagagcgctttcaaagaatgctaccttgaaggcgaccagacaagcctgtaccacgcagccaaggggctgatgaccctgcaggcgctgtatggaactatcccccagatctttgggaaaggagagtgtgctcggcaagtggccaatatgatggtcaggatgaaaagggagtttacaggcagccaaaactcagtgttccccgtgtttgataacctcttactgcttgatcgcaacgtggatctgctgacgccgctcgcctcccagctcacgtacgaaggactcatcgacgagatttacggcattcagaacagttatgtgaagttacctccagagaaatttgcacccaagaagcagggcggtggtggcgggaaggaccttcccacagaggcaaagaagcttcagctcaactccgcagaggaactctatgccgagatccgagacaagaacttcaacgctgtgggctccgtgctcagcaagaaggcgaagatcatctccgcggcctttgaggagcgacacaatgctaagacggttggagagatcaagcaattcgtctcccagcttccccacatgcaggcggccagggggtcgcttgccaaccacacctcaattgcagagttaatcaaagacgtcaccacttctgaagacttctttgataagttgacggtggagcaggagttcatgtccgggatagacaccgataaggtcaacaattacatcgaggactgcattgcccaaaagcacccgctcatcaaggtcctgagattggtttgcctccagtctatgtgcaacagtgggctcaagcagaaggttctggactactacaaaagggaaattctccagacctacggctatgagcacatactgaccctgaacaacctggagaaggccggcctgctaaaggctcagacagggggcagaaacaactacccaacgattcggaaaacattacgcctctggatggacgatgtcaatgaacaaaaccccacagacatatcctacgtgtacagtggttacgcaccactcagcgtgcgactcgcccagctcctttctcggccaggttggaggagcatcgaggaggttctccgcattctcccagggccccactttgaagaaaggcagccactgcccaccggcgtgcagaagaaacgccagccaggagaaaacagagtcacactggtgtttttcctcgggggcgtcacctttgctgaaatcgcagccctgcgttttctctcccagctggaagacggaggcacagagtatgtaattgcgaccactaaactgataaatggaagcagctggctagaagctctcatggaaaagcctttctaggctgtcagaggggacagtgagctgcccctgagaacgtgttgcccaaaggacataaagccaggagcatggaggcaacgggattgtgttccttcctgctcctctctgtgctcctaaaccctgaagaagggagggtcggcctgggtaaggacacaatgagctgggcgtggcggctcatgcctagaactcctccacttaagagacacaggcaggaggatcgctgcaagtttgggacagctggggctacatagcgagttccaggcaaaagccctcccttccagaaataaaggagatcctgtttcggaatttttaagcttaaagtcttcattttctggaatagactgtggggatgatagccccagcagccacgcaactgtgcacgggcattaaaaaggagagctaaggggataaataagaaaatagaagcggaattctgaccactgactcacggtggcattttctagaccacctatcccaggagagtggttttgggttgaatacgaagccagcatcgtccatcgcgtgcttctccccgcagagcacatttgtgtctccagtctcggctgatgtgattcctcaggcaagctttgtttcctcctgagaatctgagaagcttgaaggagcttcttgacatgatgacgtttctgctgtctgcgttgactgcgtctgtgcagttctctgataaagagtgagctaagcgccaggcagcctctgccagctaaccttcggaggcacttctgggtgtgcacgttgttaactcaagactctctggtgtaggccgccccctgatgggacttctgtcttacctccgtgtcctctgtggttggttcttctgctccttcgagttcatgcagctgtctcagtggaaactgccacatgcacctctctagccctctgactgtactcatcttcacactcccctttacctggtcagtctggtgaccgagtgcacgcggtcagtgtcagtcacacagtgacagtgcctgtgctgcagggagcaggagcaggcatgttgctgccagtgtctgcctcctgatcatttccacatctgaaggagttaagagcgccaagtggcagaccaagttgatggttttctgtcatcacccaagtctccagaaaagctagctgattcagccggtctggtcctggcccaggtgaagtttctgtggttaatagtttcccaatataaagtggtggtgtctacattatgccctgtgatgtaagtccccttagtactcaaagctgcctttgtctcttaagagtatgctctgagaaagactgtgggaacggaaggcttattcttagacagggtggattgtttacgacatgtctggacttgttctgagtttgaggactattctgctacactggctgtcccaattaaagatcctattttctgtctcaaaaaaaaa

SEQ ID NO: 2169 - DNA, 864 bp, Rattus norvegicus
  Genbank Accession No. NM_023027
atggcggccagcctctggatgggagacctggaaccctacatggatgagaacttcatctctagagcctttgccaccatgggggagaccgtgatgagtgtcaaaattatccgaaaccgcctcactggaatcccagctggctactgctttgtggaattcgcagacttggccacagccgagaagtgtttgcataaaattaatgggaaaccccttccgggagccacacctgcaaaacgttttaaactgaattatgccacttacgggaaacagccagacaacagccctgagtactccctgtttgtgggggacctgaccccagacgtggacgatggcatgctgtatgagttctttgtcaaagtctacccctcctgccggggaggcaaggtggttttggaccagacaggcgtgtctaagggctatggctttgtgaaattcacagatgagttggagcagaagcgagccttgacggagtgccagggagcagtgggactggggtgcaagcctgtgcggctgagtgtggccatccccaaagcgagccgtgtaaagccagttgagtacagccagatgtacagttacagctacaaccagtattaccagcagtaccagaactactatgcccagtggggctatgaccagaacactggcagctacagctacagctaccctcagtatggctatacccagagcaccatgcagacatatgaagaggttggggatgatgcactggaagaccctgcgccacagctggatgtgactgaggccaacaaggagttcatggaacagagtgaggaactgtacgatgcactgatggactgtcactggcagcccctggataccgtgtcatcagagatccccgccatgatgtag

SEQ ID NO: 2170 - DNA, 1572 bp, Rattus norvegicus
  Genbank Accession No. NM_023102
ctctctctgcaagtgaccctgaggccaccaagatgagcacctcggccgggcctgtgagcgtacccgggtgtcaatagccgggagccaaggggccaccaggcgcaatggtgtactaggccgggcgcgagctcaggtttcgcactcggatctcacggcagagtcaccgtggagaggccagggtaccacaaacttatggattttgacaagaaaggagggaagggggagttggaggagggcaggagaatgtccaaaaccggcacgaatcggagcaaccacggcgtccgcaattcggggaccagctcaggggtcctgatggtgggccccaacttccgagtcggcaagaagataggctgtgggaatttcggggacgttcgcctaggaaagaacctgtatacaaatgagtacgtggctatcaaactggagcccatcaagtcccgggccccgcagctgcatctggagtaccgcttctacaagcagctcagcaccacaggtgtccctcaggtctactacttcggcccttgcgggaagtacaacgccatggtgctggagctgctggggcccagcctggaggacctgttcgacctgtgcgaccgcaccttcacgctaaagacggtgctgatgatcgccatccagctgatcacgcgcatggagtatgtgcataccaagagcctcatctaccgcgacgtgaagcctgagaacttcctggttgggcggccgggcagcaagcggcagcactccatccacatcatcgactttggcctggccaaggagtacatcgaccctgagaccaagaagcacatcccgtaccgcgagcacaagagcctgacgggcacggcgcgctacatgagcatcaacacgcacctgggcaaggagcagagccgccgggacgacctggaagcgctagggcacatgttcatgtacttcctacgcggcagtctgccctggcaggggctcaaggcggacacgctgaaggaacgctaccagaagattggtgataccaagcgtgccacgccaatcgaggtgctgtgtgagagcttcccggaggagatggccacctacttgcgctatgtgcggcgcctagacttctttgagaagccagactacgactacctgaggaagctcttcaccgacctcttcgaccgcagcggctacgtgtttgactacgagtatgactgggccggcaagcccctgccgacacctatcggcaccgtccatcctgatgtgccctcccagccgccacatcgtgacaaagctcagctccacaccaagaaccaggcgctgaactccaccaatggagagctgaacacagacgaccccaccgcgggccactccaacgcccccatcgcggcccctgcagaagtagaggtggcggatgaaaccaagtgctgctgcttcttcaagaggaggaagagaaaatcgctgcagcgacataagtgagggactttggcggaaatctctacacccgtgtctcgtcatccccttcgagagcattaactatttaaaaccaggagagaagccgtgcgccgtccctcgtgcgcccctgttagctctaaagtccagcttgtcccctca

SEQ ID NO: 2171 - DNA, 4620 bp, Rattus norvegicus
  Genbank Accession No. NM_023103
taagctctgtcctcctgtcctcctgtcatcctgtcctcctgtccttccatcatgaagaagaatagagaggctcagctgtgccttttttcagctcttcttgccttcctgccctttgcttccttgctcaatggaaactcgaagtatatggtgctggtcccttcccagctctacaccgagacccctgagaaaatctgcctgcatctataccatctgaatgagacagtgactgtgacagcttccttgatatctcaaaggggaacgagaaaactgttcgatgagcttgtggttgacaaggacttgttccactgtctttccttcactatccctagattgccctcttctgaagaggaggagtcactcgacatcaacattgaaggggcaaagcataaattcagcgaaaggcgtgtggtgcttgtgaagaacaaagaaagtgttgtctttgtccagactgataagcccgtgtacaagccaggacagtcagttaaatttcgggttgtctctatggataaaaatctacaccccctgaatgagttgtttcctctggcttacattgaggatccgaaaatgaaccgaattatgcagtggcaggacattaagacagagaatgggcttaagcaattgtccttcagcctgtcagcagagcccattcagggcccctacaagatagtgattctcaaacagtcaggagtgaaggaagagcattccttcaccgtcatggaattcgtgcttcccagatttggtgtcgatgtgaaggtcccaaacgccatctctgtgtacgatgaaataatcaatgtgactgcctgtgcgatatatacctatgggaagcctgttccaggacatgtaaagataagtctttgccatggaaatccttcctttagctctgagacaaagtctgcatgcaaagaagaggactccgagctagacaacaacggctgcagcacacaagaagtgaacatcactgagttccaattaaaggaaaattacctcaaaatgcaccaggctttccatgtgaatgcaactgttacagaagaagggacagggtcagagttcagtggatctggaagaattgaagtcgaaagaaccagaaacaaattcctatttctgaaagcagactcacacttcagacacgggatcccattctttgtgaaaatccgcctagtggatatcaagggagatcctatcccaaatgagcaggtcttcatcaaagcacaagaagctggctacaccaatgctactaccactgatcagcatggcttggcaaagttctccatagataccagcagcatctcaggctattccctcaatatcaaagtctaccacaaggaggaaagttcatgtatccattcctcttgcacagcagaaagacacgcagaggaacatcatacggcctatgctgtttactccctcagcaagagctacatctaccttgacacagaagctggcgtcttgccctgcaaccagatccacacagttcaggcgcattttattctgaaggggcaggtcttgggagtgctgccacagattgttttccactacctggtcatggcccagggcagcatcctccagactggaaaccacactcatcaagtggagccaggagtatctcaagtacaaggcaacttcgccttggagatccctgtggagttcagcatggttcccgtggctaaaatgctcatctacaccatcttgcctgatggagaagtgattgcagattctgtaacgtttcaagttgaaaaatgtcttcgcaacaaagtgcacctgagcttcagcccatcccaaagtcttccagcctcacaaacccatatgcgggttacagcttctcctcagtccctctgtggcctgagagctgtggaccaaagcgtgctgctgctgaagcctgaggctgagctctccccttccttgatatatgatctaccaggtatgcaagacagcaacttcattccaagttcttatcatccatttgaagacgaatatgattgtttgatgtaccaaccaagagacactgaagagctcacatactcagtaccatatggacgagagaaggatgtctacagatatgtgagggacatgggtttaacagcattcaccaacttgaagatcaaacatcctacatattgttatgaaatgaacatggttgtactatcagcacctgctgtggaatctgaactttcaccaagagggggagagtttgaaatgatgcccttgggagtaaataaaagtccactacctaaagagccaccacgtaaagatccaccacctaaagatccagttattgagaccattaggaattattttcctgaaacctggatctgggatttagtcacagtaaactcctcaggagtgactgaagtggaaatgacagtccctgacaccatcactgagtggaaggctggagccctctgcctgtctaatgacactggtcttggcctctcttctgtggcaactctccaagccttccagcccttctttgtggagctcacaatgccctactctgtgatccgtggagaagccttcatgctcaaggccacagtgatgaactacctccctacaagcttgccgatggctgtgcagctggaagcttctcctgatttcacagctgtcccagtgggaaatgaccaagattcttattgccttggtgccaatgggaggcacacctcatcctggttggtaactcccaaatctttagggaatgtgaatttctctgtgtctgtggaagcacaacagtccccagagctctgtggttctcaggtagccacagtgcctgaaaccgggagaaaggacacagtagtcaaagtcttgatagttgagcctgaaggaatcaagaaagagcataccttcagctcacttctctgcgcatcagatgctgagctgtcagaaacattgtctctgctgcttccaccaacagtagtgaaagattcagccagagcacatttctctgtgatgggtgatatcttgagttcagccataaaaaacacacaaaatcttatccaaatgccctatggctgtggggagcagaacatggtcctttttgctccaaacatctatgttctgaaatatctgaatgaaactcaacagctgacagagaagatcaagtccaaggcccttggttacctcagagctggttatcagagagaactgaactacaaacacaaagatggctcctacagtgcttttggggatcacaatggccagggtcaaggaaacacttggctcacagcctttgtgctcaagtcttttgcccaagctcgagccttcatcttcatcgacgaatcacacatcaccgacgccttcacctggctctccaagcagcagaaggacagtggctgcttcaggagctccggatcactgttcaacaatgccatgaaggggggagtcgatgatgaaatcaccctctctgcctatataaccatggcccttctggaaagttcactcccagacacggatcctgttgtctccaaagccctgggctgcctagaggcatcttgggagaccatagagcaaggaagaaatggcagctttgtgtacaccaagacactgatggcctatgctttcgctcttgcgggaaaccaggaaaagagaaacgaaatcctgaaatcccttgataaggaagctataagggaagacaactccatccactgggaaagacctcagaaacccacaaaatcagagggttatctgtacacaccccaggcttcctctgctgaagtagagatgagtgcctatgtcgtcttagctcgcctcactgcccagccagccccatcccctgaggacctggctttgtcaatgggcaccatcaagtggctcacaaagcagcagaattcccatggcggcttctcctccacacaggacactgtggtggcccttgatgctctgtccaaatacggagcagctactttttccaaaagccagaaaactcctttggtgaccattcaatcttcagggtcattttcccaaaagttccaagtagacaacagtaatcgcctgttactgcagcaggtctcattaccagacattcctgggaactataccgtcagtgtgtcaggggaaggatgtgtgtatgctcagaccacgctgagatacaacatgcccttggagaagcagcagcctgcatttgctctaaaggtgcagacagtacccctgacttgtaacaaccccaaaggccagaacagcttccagatctcactagaaatcagttacacggggagccgtccagcctccaacatggtgattgctgatgtgaagatgctctctggcttcatcccattgaaaccaacagtgaagaagcttgaaagattagagcacgtaagcagaacagaagtgaccaccaacaacgtcctgttatatttggaccaggtaaccaatcagacactgtccttctccttcatcattcaacaagacatcccagtaaagaacctgcagcctgccattgtgaaagtgtatgactactatgagacagatgaagtggcttttgctgaatacagcagcccctgcagctcagacaaacaaaatgtttgaaactcatatctgtggacaaggcattgctggaatccccaaaccagagaactttcaaggtggtgatttgtgtttgtctctgaaatacaaatactgaacaatcttggt

SEQ ID NO: 2172 - DNA, 1408 bp, Rattus norvegicus
  Genbank Accession No. NM_024125
acgggaccgggacgcagcggagcccgcgggccccgcgttcatgcaccgcctgctggcctgggacgcagcatgcctcccgccgccgcccgccgcctttagacccatggaagtggccaacttctactacgagcccgactgcctggcctacggggccaaggcggcccgcgccgcgccgcgcgcccccgccgccgagccggccatcggcgagcacgagcgcgccatcgacttcagcccctacctggagccgctcgcgcccgccgccgcggacttcgccgcgcccgcgcccgcgcaccacgacttcctttccgacctcttcgccgacgactacggcgccaagccgagcaagaagccgtccgactacggttacgtgagcctcggccgcgcgggcgccaaggccgcaccgcccgcctgcttcccgccgccgcctcccgccgcactcaaggccgagccgggcttcgaacccgcggactgcaagcgcgcggacgacgcgcccgccatggcggccggcttcccgttcgccctgcgcgcctacctgggctaccaggcgacgccgagcggcagcagcggcagcctgtccacgtcgtcgtcgtccagcccgcccgggacgccgagccccgccgacgccaaggccgcgcccgccgcctgcttcgcggggccgccggccgcgcccgccaaggccaaggccaagaaggcggtggacaagctgagcgacgagtacaagatgcggcgcgagcgcaacaacatcgcggtgcgcaagagccgcgacaaggccaagatgcgcaacctggagacgcagcacaaggtgctggagctgacggcggagaacgagcggctgcagaagaaggtggagcagctgtcgcgagagctcagcacgctgcggaacttgttcaagcagctgcccgagccgctgctggcctcggcgggtcactgctagcccggcgggggtggcgtgggggcgccgcggccaccctgggcaccgtgcgccctgccccgcgcgctccgtccccgcgcgcgcccggggcaccgtgcgtgcaccgcgcgcacctgcacctgcaccgaggggacaccgtgggcaccgcgcgcacgcacctgcaccgcgcaccgggtttcgggacttgatgcaatccggatcaaacgtggctgagcgcgtgtggacacgggactgacgcaacacacgtgtaactgtcagccgggccctgagtaatcacttaaagatgttcctgcggggttgttgctgttgatgtttttgtttttgttttttgttttttgttttttttttggtcttattatttttttgtattatataaaaaagttctatttctatgagaaaagaggcgtatgtatattttgagaaccttttccgtttcgagcattaaagtgaagacattttaaaaaaaaacggcacgag

SEQ ID NO: 2173 - DNA, 711 bp, Rattus norvegicus
  Genbank Accession No. NM_024127
gggactcgcacttgcaatatgactttggaggaattctcggccgcagagcagaagatcgaaaggatggacacggtgggcgatgccctggaggaagtgctcagcaaggctcggagtcagcgcaccataactgtcggcgtgtacgaggcagccaagctgctcaacgtagacccggacaacgtggtcctgtgcctgctggctgcggatgaagatgacgaccgggacgtggctctgcagatccatttcaccctcattcgtgctttctgttgcgagaacgacatcaacatcctgcgggtcagcaacccgggtcggctggcagagctgttgctactggagaacgacaagagccccgctgagagcgggggcctggcgcagaccccggacttacactgtgtgctggtgacgaacccacattcatcacaatggaaggatcctgccttaagtcaacttatttgtttttgccgggaaagtcgctacatggatcagtgggtgccagtgattaatctccccgaacggtgattccccgaacggtgatggcatctgaatggaaataactgaaccaaattgcactgaagttttgaaatacctttgtagttactcaagcagtcactccccacgctgatgcaaggattacagaaactgatgtcaaggggctgagttcaactacaggagggctaggagatgactttgcagatggacagagaggtgaaaata

SEQ ID NO: 2174 - DNA, 628 bp, Rattus norvegicus
  Genbank Accession No. NM_024131
tgaattcctggaacctcaactggctcccactgctctctcggtgcagttaccgtttggcgatccctctcctgctaacatgccgttcgttgagttggaaacaaacttgccggctagccgcatacccgcagggctggagaaccggttgtgtgcggccacagccaccatcctggacaaacccgaagaccgcgtgagcgtgacgatacgaccgggcatgaccttgttgatgaacaaatccacagagccctgcgcccacctcctgatctcttccatcggtgttgtgggcaccgcggagcagaaccgcagccacagctccagcttcttcaagttcctcaccgaggagctgtccctggaccaggacaggatcattatccgattcttccccttggagccctggcagatcggaaagaaaggaactgttatgacgtttctgtgatggagacaaggaacgcagggcgtttgcttgagcctgtccagagcccttccagagaggcctcctggcagatacgataccagatccctcttttgcataagtgtctgtgatctcactgacctgttttcctctcccccagcctcgtgaacgagagagcaataaagaagagagcataatcccaaaaaaaaaaaaaaaaaa

SEQ ID NO: 2175 - DNA, 2897 bp, Rattus norvegicus
  Genbank Accession No. NM_024138
aggcaccaaaccctagtttgccggggcctccggagcagctggctgagggttcctgtcgctgcctgggccgggtgtgacctcccgtccacacagacccagacaccagcctggcaccctgcggtgccaaattaatgcacagtatttctcttccagggtgtgaagccttcctattggaacctcggtgctgggacagtgggactcagagcagctctctagacgccaggtccacgctcatggctgatgatgtcaggtactaacaacgtcgcccaggcccggaagctggtggagcagttgcgcatcgaagctgggatcgaacgcatcaaggtctccaaggcctcgtcagaactgatgagctactgtgagcaacatgcccggaatgaccccttgctggttggtgtaccagcctctgaaaatccattcaaagacaaaaagccttgcataattctctagttctctctctcttcctccctccttcctctccctctctttctccccaccccaaaggtattgtccagtttttcctgtaagaaaaaaatatttgaatcccttctactttgaattttaaaggaacagaaaccattgtgaatgcctggagcctcctgacctagctggagttcgtcctggcctaactttagcctcatccaccccctcccgtcgagaaccactgatgtgacagtttttaagctccccttagttggcctggggaaagggttctgttggccaacggcgagcctagcaagtttgcggaccatagctgcagtcctcgggtcccacataaaacatgcaggtgcggtgtcagaaggctgagatggaaggatccccgaggcttggggactgcatcctagcagccagtaaactccagacagtgagaaacgatgcctccaaacacaaggcagaggaggatacccagccttgacctctggctccacacgcggcacacacaatgcaccctgtactacccagtgtcattctcgagtggccctgtcgtgtgcacggtgacagtgatgccctttctccagagagttggcccattctagaaacgggcatttgggtctccatacaaaggaagcacttgctggtatggccgagtgtgtaactttgtctccgaagcctgagatccatgtgttcattggtgactcctcgtttttctcccagttacacagatggttgtgagggcagaagtgcagatttaattatcttgaggtgattgagaaggaccgatggggttctccatcccacacgtgactgtgcctccagatcccccttcctgggtcaaactattttttaactaactagaacccaagtccctcaatgtgtggactgtggccattttctgcactccttcattgggagattcatctctgaccacacccccaacccctcactgagggattctagacggggctccacccctgaccacgccccagtcccccattgagggattctagaaggggttccacctctgaccatgcctcagccccctactggggattctagaaggggctccaccctgaccacgcccccagacccttactggtaaattctagatggcactccacttctgaggcgggcatcttctctattgtgtgagcagagccctagagtccaggctggcctggactggaactggagatcttcctgcctctggctccggagtacctacctgataggcctgtgttgcatgcctggcatcggattggacggaagatgacagaccgtctgtctatgacagtgacagtggcaggtctagggaggacacagcttaggtgtgccagtgtggtctgcagccatacacaaaggcatctcaagcatttgagactccagttacctctttctcctgccggatcagtgtgggagcagaaatgaagccagtccagttactccctgcagctctggtggaaatctgcttcccaaaccctgtgccaggctcatccctggacagttgctcaaactgcccatgggcaaagtgaatggagctggcagatctggctcctagcctattaggcacaacctaccacctagataaggtggcagccccccccctccccagtccatttgatggaatcagggaaagaagtttgggatgtgactaagggggaggggcactgcaggtgctaagagaggaccctgtttccccctccatgggccacagagagcacagaccaagggtcaggcccctcctgtgcactgactcccaattactggtcagagagggccaggactttggtgagcctgactctcagaacctgtggtggaatcagaaaagccagtgtccctccagaactgcagccacctttcattaggctaggaaccaggtcccagcaggtgtgtctccagctgcactggcaggggacagtgaggagagaggaaaggacatacattctggggaccgggactgcagaacacccagccagtatggtagaaacctgggttccaccccaagctcgcaaaaaaacaggcatgggcactggggatgtagaggcaggaagatcagaacttcagggtctttctcagccacaggatgggctcaaggttagcctgggctgcatgagaccatgtctcaaagacagaaatctcagtgtgctctctcatgttcctaacacgcctgattgtttccctctggaggctgctgtgccagcctggccagcctgcgtttggtcgcagccttgtttctcagctctgggacaaaaactcaaatctgcatctctgcccacacctccagttccccctccccgggtgactcacaggccaaggacaaagtggcctcttgctcccagggagggtaggatgtgctggtgtagcctgtgtacgtcctaagcactggagccctgcctcggcctagagacgcttagggaaaccagaacacatcagagcaattaggagccaagaatggtggc

SEQ ID NO: 2176 - DNA, 2469 bp, Rattus norvegicus
  Genbank Accession No. NM_024146
atgtggggctggaggggcctcctcttctgggctgtgctggtcacagccactctctgcactgccagaccagccccaaccttgcccgaacaagctcagccctggggagtccctgtggaagtggagtctctcctggtccaccctggtgacctgctacagcttcgctgccggctgcgcgatgatgtgcagagcatcaactggctgcgggatggggtgcagctggcggaaagcaaccgtacacgcatcacaggggaggaggtggaggtgcgggattccatccccgctgactctggcctctacgcttgtgtgaccaacagcccctctggcagcgataccacctacttctccgtcaatgtctcagatgcactgccatcctcggaggacgatgacgatgatgatgactcctcctcagaggagaaagagacagacaacaccaaaccaaaccgtaggcctgtggcgccatactggacatccccagagaaaatggagaagaaactgcacgcagtgccagctgccaagacggtgaaattcaaatgcccgtcgagtgggacacccagccccactttgcgctggttgaaaaacggcaaggaattcaaacctgaccaccggatcggaggctacaaggttcgttacgccacttggagcatcataatggactctgtggtgccttctgacaagggcaactacacctgcatcgtggagaacgagtatgggagcattaaccacacctaccagctagacgttgtggagcgatcccctcaccggcccatccttcaggcagggctaccagccaacaagaccgtggccctgggcagcaacgtggagttcatgtgcaaggtgtacagtgacccccagcctcacatccagtggctgaagcacatcgaggtgaatgggagtaagatcggtccagacaacttgccgtatgaccagatcctgaagactgctggagttaataccaccgacaaggaaatggaggtgcttcatctacggaatgtctcctttgaggatgcgggggagtatacgtgcttggcgggtaactctatcggactctcccatcactctgcatggttgaccgttctggaagccctggaagagagaccagccgtgatgacctcacctctgtacctggaaatcattatctactgcaccggggccttcctgatctcctgtatggtgggctccgtcatcatctacaagatgaagagcggcaccaagaagagcgacttccatagccagatggctgtgcataagctggctaagagcatccctctccgcagacaggtaacagtgtcagctgactccagcgcatccatgaactccggggttctcctggttcggccttcgcgactgtcctccagcggaacccccatgctagctggcgtctctgaatatgagctccctgaagatccccgctgggagctgccccgggacagactggtcttaggaaaaccgcttggcgagggctgcttcgggcaggtggtgttggccgaagccatcggtctggataaggacaaacccaaccgcgtgaccaaagtggccgtgaagatgttgaagtctgatgcgacggagaaggacctgtcggacctgatctcggagatggagatgatgaaaatgatcgggaagcacaagaatatcatcaacctgctgggggcgtgcacacaggatggtcctctctatgtcattgtggagtatgcctccaaaggcaatcttcgggagtatctgcaggcccggaggcctcctgggctggagtattgctacaaccccagccacaaccctgaggaacagctgtcttccaaagatctggtgtcctgtgcctatcaggtggcccggggcatggagtatcttgcctcgaagaagtgtatacaccgagacctggctgctaggaatgtcctggtgacagaggataatgtcatgaagatcgcagactttggcctagctcgagacattcaccatatcgactactataagaaaaccaccaatggccggctgcctgtgaagtggatggcacctgaggcattgtttgaccggatctacacccaccagagtgatgtgtggtcttttggggtgctcttatgggagatattcactctgggtggctcaccaaaccccggcgtgcctgtggaagaacttttcaagctgttgaaggagggtcatcgaatggacaagcccagtaactgtaccaatgagctgtacatgatgatgcgggactgctggaacgcagtgccctctcagagaccaactttcaagcagttggtggaagacctggaccggattgtggccttgacctccaaccaggagtatctggacctgtccatgccactggaccaggactcgccaagctttccggacacacggagctctacctgctcttcaggggaggactctgtcttctctcatgagccatttcctgaggagccctgtctgccccgacaccccacccagcttgcaaatggcggactcaaccggcgctga

SEQ ID NO: 2177 - DNA, 1213 bp, Rattus norvegicus
  Genbank Accession No. NM_024148
agacagactccattctttgtgcagtgaggggctccctgcctcgttgggaggcagcgtagtaaacactgcttcggtgctccagacgcctaagggctttcgttacagcgatgccgaagcgggggaagagagcggcagcggaagacggggaagaacccaagtccgagccagagaccaagaagagtaagggggcagcaaagaaaactgagaaggaggccgcaggagagggccctgtcctgtatgaggaccctccagatcagaaaacgtcagccagtggcaaatctgccacactcaagatatgctcctggaatgtggatgggcttcgagcctggattaaaaagaaaggcttggattgggtaaaggaagaagcaccagacatcttgtgcctccaagagaccaaatgctcagagaacaaactcccggctgaactgcaagagctgcctggactcacccatcagtactggtcagctccatcagacaaagaaggatatagtggtgtgggcctactttcccgccaatgcccgctcaaagtctcttatggcattggtgaggaagaacatgatcaagaaggccgggtgattgtggctgaatttgagtcctttatcttggtaacagcctatgttccgaacgcaggaaggggtctggtaagactggagtaccgacagcgatgggatgaagccttcagaaagtttctaaaggacttggcttcccggaaacctcttgtgctgtgtggggatctcaatgtggctcatgaagaaatagaccttcgtaaccccaaaggaaacaaaaagaatgctggttttactccccaggagcgccaaggctttggggaaatgctacaggctgtaccactggctgacagcttccggcatctctaccccaacactgcctacgcttatactttctggacttacatgatgaatgcccgctctaagaatgttggttggcgccttgattactttttgctgtctcactctcttttacctgctttgtgcgacagcaagatccggtccaaggctcttggcagtgaccactgtcccatcaccctttacctagcactgtgacactcccctcaagtagcttcatgctgggaaatagcctcctctcctccaggagaccagtgcgttatctcttcttcaggtgtttactcccctctaaaccaaacttctggtttcctttaaacaatccaagtgaaataaaagtcctacttttcaac

SEQ ID NO: 2178 - DNA, 1700 bp, Rattus norvegicus
  Genbank Accession No. NM_024150
ctttaactttttttacttagaacaattgtccgtgtattttacatgtgttacttttatatgtcatcaatgtagagtaaccgttctacttgctttttgttcaggttgcagaattcagctacgatggggaacgtttttgaaaagttgtttaaaagcctattcgggaaaaaggaaatgcggattctcatggtgggcttagatgcagctggcaaaacgacgatcttgtacaaactgaagctgggagagattgtgacaaccatccccaccataggtttcaacgtggagaccgtagaatataaaaacatcagcttcacagtctgggatgttggtggccaggacaaaatcagacctttgtggcgacattacttccagaacactcaaggtctgatattcgtggttgatagtaacgacagagagcgggtcaatgaggcccgggaagaactgaccagaatgctagcagaagatgagctcagagacgcagtcttattggtgtttgtaaacaaacaggatcttcctaatgctatgaacgcagcagagatcacagacaagcttggcttacattcacttcgccagagaaactggtacattcaggctacctgtgcgaccagtggagatgggctttacgaaggcctggactggctctccaaccaactcaagaaccagaagtgatcagaagcagcccattccccatgccttgtggcaaaggcagctggcctttcccgtgtgcatgtgagtgcgtgaggagccatgtggccgtgtggctgggagtggggcagctttctcacaccgtgccttatccacgctatacgaacaccagtactccattttaagaaaaccagtgttacatttggaatgctaccgtccatttcacgagctttgatggtcttttcgctgaggcctccccggtgtgatagccagaatatctctaggctggaaaagaagagagctggaggcaggcaggtcccgttgttgccatcctgggtttggcctctccacacactcggaatcccgttggactttggtgtccttttacaaaaagaaaggaagggctgccattctttccattgtgccaaagctagcagctcacttgtagtgctttaaagctgtcaagaagaaggatacgttattaccacagtgtgagaggttcagaggggaatacttccccagagttctgttagttcaaactgacgcatttagctgttttagtccaaggaatcagtgacctttttcattagagtatcaagactgtaacactagagaagtttccagcctgtcccatacttgccaaacggaaactctgtgggctgctggcccaacaggaggccagaactcttccctaagcctcctggtccacagcggagtaaaggttgtggggagtgaagtgaggtagctcttgtgtctggcatcacgtctcagtcccctgaggctgcttctcccacttctctgctctgtgctgagtgttcttcacatgcagcagacagtgctcctggtggagttgtcactgtgtccccttgtccaggtctactgtgggcttttgattagtatctgtttccagaaccgcacacccgtgagttctgagtgtgtgtgagaaagtcaggaggttaatttagaagatgaaggtcccagtggcccccatactccctgggtggtgctaaactttgctctgagaagcgccttttcttcagactgctctcactctccct

SEQ ID NO: 2179 - DNA, 1608 bp, Rattus norvegicus
  Genbank Accession No. NM_024151
gacagccgaacacttaacgccgcgccggagccaccgcaccagtcgccgagcaggtcccggtcccgctacgtcgtgtcccgcggctctgccgacactccggcctgagagacgggtcttcagccttttctcttccgcccactcagttgtgagccggaaccgtgaaggcccgagggcggaccagaccctctctttttttgaccatcaagtgccaccaccgctatgggcctcaccatctcctctctcttctcgcgcctcttcggcaagaagcagatgcgcattttgatggttggattggatgctgcgggcaagacgacgattctgtataaactgaaactaggggagatagtcaccaccattcctaccattggttttaatgtggaaacagtagaatataagaacatttgtttcacagtttgggatgttggtggtcaagataaaattaggcctctctggaggcattacttccagaatacccagggtctcattttcgtggtagatagcaatgatcgtgaaagaattcaggaaggagcagccgtgctgcagaaaatgcttctggaagatgagctgcaggatgctgtgctgctgctttttgccaacaaacaggatttgccaaatgctatggccatcagtgagatgacagacaagttaggtcttcagtctctccggaacagaacatggtatgtccaagccacttgtgctacacaaggaactggtctgtacgaggggctggattggctgtcaaatgaactttcaaaacgctaaatgaaactggatatctaaccaaggacatgtttgatagaattggtctaggcttgttacaacaaaattagtttgcatcttggttattaaaggatatctgagacggtttgggcagaaattacagcatttaaaacttgttttgttgccaattattgtttaccaagaacaatgttgctgtttagcaatatgcttgggtttaagagaaattctccttgggggaaaaaagtgtccattattatacttcccctgaacctgaatgcctggatagatagcgattgtgacacccttaaataaatctgttttgagtgttttttgagcccacaccaataatgttttaaagttacccccttggaactcactgatacctatcattcctcgggcagtctgctgagttaaaaatgtagcattccatttgtatttatttcccccttgccaaaaagatttttctaataatgcttgtactggccagggatgagctccacaacactattcagttttcttgtactgaggattcccccacctccctcacattattgactcctggcttctatcagccaaactttgatgtagtttggatttgatagctaattctgggctggtttcaaagagttcatattgagataacttttaatactcagcaaattgtcttcctttatattatcttttttatgttgcatgttgccttttggaatcagcctgactctttgcccagcatatgatagttctgctggtattttactgtttactgatgaacatatcttcattaagaattttttgaaaactcatcaaattcaatgaataagttttcttcataacccatttggaattattcctaataaaatgattttt

SEQ ID NO: 2180 - DNA, 995 bp, Rattus norvegicus
  Genbank Accession No. NM_024152
agcaggcacgttcgcgcaagccgggccgcagggcgtcctcgcggcggggcggctacttttcgggctcgcagcggcggcggcgttgtaggctgaggggacccgggacacctgaatgcccccggccccggctcttccgacgcgatggggaaggtgctatccaagatcttcgggaacaaggaaatgcggatcctcatgctgggcctggacgcagccggcaagacaacgatcctgtacaagttgaagctgggccagtctgtgaccaccattcccacggtgggtttcaacgtggagacggtgacttacaaaaacgtcaagttcaacgtgtgggatgtgggcggccaggacaagatccggccgctctggcggcattactacaccgggacccagggtctgatcttcgtggtagactgcgccgaccgggaccgcatcgatgaggcccgccaggagctgcaccgcattatcaatgaccgggagatgagggacgccataatcctcatcttcgccaacaagcaggacctgcctgatgccatgaaaccccatgagatccaggagaaactgggcctgacccggattcgggacaggaactggtatgtgcagccctcctgtgccacctccggggacggactctatgaggggctcacatggttaacctctaactacaaatcctaatgagcgccctccacccagcccccggaaggagagaaatcaaaaacccattcataggattatcgccaccatcatcacctctttcaattgccactctcttttttgaaactgaactcgagttactgttctaccgtttagtggggttgggggttttctttgttccccttaccccccctcttctatttcctttcggctttgcgttaggatgctctgatctgacatttgacacgaatacagtgctatatgctcttgtgacttccagcaaacggggtaatagcaactcttggtaaagtcctttataataatggttgattttttttttttatttc

SEQ ID NO: 2181 - DNA, 2739 bp, Rattus norvegicus
  Genbank Accession No. NM_024156
ggaattcccgtctatctgtctgccctgatccgaggcctccccagagcgtggtttctgctgcagaacctgagaccatggccaaaatagcacagggtgccatgtaccgaggctctgtccacgacttcgcagactttgatgcaaatcaggatgccgaggctttgtacacagccatgaagggcttcggcagtgacaaggagtccatattggagctgatcacctcccgcagcaacaagcagaggcaggagatctgccagagttacaagtccctctatggcaaggacctcatcgcagacttgaagtatgagttgacagggaagttcgagcgactgatagtgaacctgatgaggccgcttgcctattgtgacgccaaagagattaaagacgctatctcgggcattggcactgatgagaagtgcctcattgaaattttggcttcccggaccaatgagcagatacaccagctggtggccgcatacaaagatgcctatgagagagacctggagtctgacatcattggagacacttcaggccacttccagaagatgctggtggtactgctccagggaacccgggagaatgacgatgttgtgagtgaggacttggtccagcaggatgtccaggacctgtatgaggcaggggaattgaaatggggaacagatgaggcccagttcatctatatcttgggaaaccgtagcaaacagcacctacgattggtgtttgatgagtacctgaagaccacagggaagcccatcgaagccagtatcagaggggagctgtctggagactttgagaagctgatgttggccgtggtgaagtgcatccgaagtaccccggagtattttgctgaaaggctgttcaaagccatgaagggcctggggactcgagacaacactctgatccgtatcatggtctccaggagcgaactggatatgcttgacatccgggagatcttccggaccaagtatgagaagtcactctacagcatgatcaagaatgatacctctggtgaatacaagaaggctttgctgaagctatgtggaggggacgatgatgccgctggccagttcttcccggaggcagcacaggtggcctatcagatgtgggaacttagtgcagtgtcccgagtcgagctgaagggtaccgtgcgtgcggccaacgatttcaaccccgatgctgatgccaaaggcctgcggaaagccatgaagggaattggaaccgacgaagccaccatcatcgacatcatcacacagcgcagcaatgtccagcggcagcagatccggcagaccttcaaatctcactttggccgggatttaatggccgacctgaagtccgagatctcaggagacctggcaaggctgatcctggggctcatgatgccacctgcccattacgatgctaagcagctgaagaaagctatggagggagccggcacagatgaaaaggctcttatagaaatcctggccacccggaccaatgctgaaatccgagccatcaatgaggcctacaaggaggattatcacaagtccctggaggatgccctgagctcggacacatctggccacttcaaaaggatcctcatttctctggccacagggaatcgagaggaaggaggagaaaaccgggaccaggctcaggaagatgctcaggtggctgctgagatcttggaaatagcagacacacccagtggagacaaaacctccttggagactcgattcatgaccgtcctgtgcacccgtagctatccccacctgcgcagagtcttccaggagttcatcaagaaaaccaactatgacatagagcatgtcatcaagaaggagatgtctggggacgtcaaggacgcatttgtggccatcgttcagagtgtcaagaacaagcctctcttctttgctgacaaactgtacaagtccatgaagggtgccggcacggatgagaagaccctcaccagggtgatggtgtcccggagtgagatagacctgctcaacatccggagggaattcattgagaaatatgacaagtctccacaccaagccattgaaggtgacacctctggagacttcatgaaggctttgctggcgctctgtggtggagaagactaaaactcatggccttggagggtccccctgccatgcagtggccaaccgcaccagccaccgtgacctgaccaagccattgctccagcttcagagactaaggaagaagtgaggggtggagttggactgtgatccggctggggtgctctcttgccattgagggtcccaggcggtcccttctgttatccctcctgctcatggctaagtggctggtgaaccacagccatatatgcattcaaccctgctccccgtctgcctccttctccgcccaccctagcttccatccctccacacgaatccctgcctgatttaagctttgtcacatctctaaacacctccttggatggagccaccctgcccccagccctgaacagccgggggagggtagagagttcctcagagctggctcccagctgtgtccatcattggagtggcagcaggcaggtttcatacagtgctgtggactcgagaagccgttacactggactggaatggtggacagttgggtcacttactggaccccaatggagaaaagtgtgtcaccactcctcgccaagtctctgcttgtcttttccaataaattcggaaaagtggatcaagaataccttggcagggaataggggggcaaagtttagaacagagggaattc

SEQ ID NO: 2182 - DNA, 3170 bp, Rattus norvegicus
  Genbank Accession No. NM_024159
cccgtcatgtctaacgaagtagaaacaagcacaaccaatggtcagcctgaccaacaggctgcaccgaaagcaccatcaaagaaggaaaagaagaaaggttctgaaaagacagatgagtatctgttggccaggttcaaaggtgatggtgtaaaatacaaggccaagctaatcggtattgatgatgtgcctgatgcgaggggagacaaaatgagtcaggattctatgatgaaactcaagggaatggcagcagctggtcgctctcagggacagcacaagcaaaggatctgggtcaacatttccctgtctggcataaaaattattgatgagaaaaccggggtaatagagcatgaacatccagtaaataagatttccttcattgctcgtgatgtgacagacaatagagcatttggttatgtgtgtggaggagaaggccagcatcaattttttgctataaaaacagggcaacaggctgaaccattagtcgtcgatcttaaagacctttttcaagttatctataatgtaaagaaaaaggaagaagaaaagaaaaaggttgaagaagccaacaaagcggaagagaatgggagtgaggccctaatgacccttgatgatcaagctaacaaactgaagctgggtgttgaccagatggatttgtttggggacatgtctacacctcctgacctaaataatccaacagaaagcagagatatcctgttagtggatctaaactctgaaatcgacaccaatcagaactctttaagagaaaatccattcttaacaaatggagtcacctcctgttctctccctcgaccaaagcctcaggcatccttcttgcctgaaagtgccttttctgccaatctcaacttctttcccacccctaatcctgatcctttccgtgatgatcctttcgcacagccagaccaatcggcaccctcttcgtttcattctctcacatctgcagatcagaagaaagcgaatccgggtagcttgtctactccacagagtaaagggcccttgaacggtgatactgattactttggtcagcaatttgaccagatctctaaccggactggcaaacaggaagctcagggaggcccatggccctatccaagttcgcaaacccagcaagcagtgagaactcaaaatggggtatctgaaaaagaacagaacggcttccatatcaaatcttccccgaacccttttgtgggaagccctcccaaaggactatcggtaccgaatggcgtaaagcaggacttggaaagctctgtccagtcctcagcgcatgactccatagccattatcccacctccacaaagtaccaaaccaggaagaggcaggaggaccgctaagtcttcagcaaacgacctgcttgcttcagatatctttgcctcagaacctccaggccagatgtcccccacaggacaacctgcagtcccacaggcgaactttatggatctcttcaaaaccagtgctcctgccccaatggggtcggggcccctcgtaggtctaggtactgtcccagtaacacccccccaagcaggaccttggacacctgttgtcttcactccttctacaactgtggtcccaggagccataataagtggccagccttccggttttggtcagccactcgtctttggtacaaccccagcagtgcaagtttggaatcagccttcatcatttgcaactgcagcttcccctccacccccggcagtttggtgtcctaccacatctgtggcacccaacacttggtcatccacaagtcccctggggaatccttttcagagtagtaatatctttccaccttccaccatatccactcagtcctttcctcagcctatgatgtcctctgttctggtcacacctccccaaccacctccccgaaatggcccactaaaggacactcttagtgatgccttcactggcttagacccacttggggataaagaggtcaaggaagtgaaagaaatgtttaaggacttccagctgcggcagccacctcttgtaccctcgaggaagggggagacaccttcctctgggacctcaagcgccttctccagttacttcaacaataaagttggcattcctcaggagcatgtagaccatgatgattttgatgccaatcaactgttgaacaagattaatgaaccaccaaagccagcccccagacaaggtgtcctctcgggtaccaaatctgctgacaattcactcgagaaccctttctctaaagggttcagctcaacaaacccctccgtggtctctcagcctgcatcttctgatgcccacaggagcccttttggaaatccttttgcctaacttctttctgaagttgtaatgctgactgactatccagatgagcaaaaggctggctttggtcaaggattaagcagatagccagaaacgtgctgacctctgtccttgctccagctttgatgtattacctgttaccctacttgtctttgcctcatgtacttgtaaaaagcctttcactctctctaggctaaagctacactgaaacaatggctttacataaattaaactcctaagctctctagctccaatataaatgaagtagcttccctaccaaatccttgtctgtcgtgctcctagaaccttccagaatattctccgttttaccctcaatttgggaggtgtggccacctttacccttaatatcacactgccttgagtaaatgtccaaatccttgtagctctcaaggtcatttgtgattcctggtgtgcatcataaatctaaacattaatattaacattaataggaaagcaagacaccttgcttcccattcccactcagacaagtttttttatgataaaatgaaagcaagactaacttctcgaatccacccaaggaccatttcgagatggtctttctcagctaattgcatcatttaccaatcctactccaagtggtgtttacatttgacttgaaaaggagaaaggtctaactcaaaacataaggcattattcaaagctaataaaacaatttctccctggggccccacattgttttcattccagacactttgcagctgtttgaccctgatgatattatgccctacattttccttgaagattctgattttatttcatgtgattcttttttctcaataaagatgattattgtgtgcatttactaaacaaacaaaaaaaaaaaa

SEQ ID NO: 2183 - DNA, 709 bp, Rattus norvegicus
  Genbank Accession No. NM_024160
ccacgcgtccgggaccgagcggctgcgtgtgctgggtcctcaccatggggcagatcgagtgggccatgtgggccaacgaacaggcgctggcatctggcctgatcctcatcacagggggcatcgtggctactgcgggacgcttcacgcagtggtactttggtgcttactctattgttgcaggagtgctcatctgtctgctggagtacccccggggaaagaggaaaaagggctccaccatggagcggtgtggacagaagtacctgaccgctgtggtgaagctgttcgggcccctcaccagaaattactacgtccgggctgtcctccacttactgctgtccgtgcctgcaggcttcctgctggccaccatcctggggaccgtctgcttggccattgccagtgtgatctacctgctggcagccatccggggtgagcagtggactcccattgagcctaaacccaaggagcggccgcaggttggaggcaccatcaagcagccacctaccaaccccccaccccggccaccagcggaggtccgcaagaagccaagtgaggccgaagaggaggcagcctcggcaggaggaccccaggttaacccaattccagtgacagatgaggtcgtgtgaccttcagtggctcctgcttgagtttccaaggtgttgctcccagagggtggtgatgcccactgtaataaacatggttaatagctggt

SEQ ID NO: 2184 - DNA, 666 bp, Rattus norvegicus
  Genbank Accession No. NM_024162
ctcacgaccgacatcgacctcctttctcattgcaccatggcggacgcctttgtcggtacctggaagctagtggacagcaagaattttgatgactacatgaagtcactcggtgtgggctttgccaccagacaggtggctagcatgaccaagccgaccacaatcattgagaagaatggggataccatcaccataaagacacacagtaccttcaagaacacagagatcagctttcagctgggagtagagtttgacgaggtcacagcagatgacaggaaggtcaagtcggtcgtgacactggacggaggcaaactggtccatgtgcagaagtgggacgggcaggagactacgcttacacgggaactaagtgatgggaaactcatcctgactctcacccatggcaatgtggtgagcactcggacttacgagaaggaggcgtgacctggctgccccgtcactgactgctcctctgccaatggctacccctaactcagcaccacgttgcctcatgtttctcccctctgacgttttatataaatactctttggttgggcttttcctggagatatgggacaccagcctggacccaggtcccattgtgtatgtggtttattttttaaatgtatccaaagggtgctccaaggtcaataaagcagagccaaggccacc

SEQ ID NO: 2185 - DNA, 2073 bp, Rattus norvegicus
  Genbank Accession No. NM_024351
gtctctgtgtggtctcgtcatcagcacagctgggcctacacgcaagcaaccatgtctaagggacctgcggttggcattgatcttggcaccacctactcctgtgtgggtgtcttccagcatggaaaggtggaaataattgccaatgaccagggtaaccgcaccacgccgagctatgttgctttcaccgacacagaacgattaattggggatgcggccaagaatcaggttgcaatgaaccccaccaacacagtttttgatgccaaacgtctgatcggacgtaggttcgatgatgctgttgttcagtctgacatgaagcactggcccttcatggtggtgaacgatgcaggcaggcccaaggtccaagtcgaatacaaaggggagacaaaaagtttctatcctgaggaagtgtcttcaatggttctgacaaaaatgaaggaaattgcagaagcttaccttggaaagactgttaccaatgccgtggtcaccgtgccagcttacttcaatgactctcagcgacaggcaacaaaagatgctggaactattgctggcctcaacgtacttcgaattatcaatgagccaactgctgctgctattgcctatggcttagataagaaggtcggggctgaaaggaatgtgctcatttttgacttgggaggtggcacttttgatgtgtcaatcctcactatcgaggatggaatttttgaagtcaaatcaacagctggagacacccacttgggcggagaagactttgacaaccgaatggtcaaccatttcattgctgagtttaagcgaaagcacaagaaggacatcagtgagaacaagagagctgtcaggcgtctccgcactgcctgtgagcgggccaagcgcaccctctcctccagcacccaagccagtattgagattgattctctctatgagggaattgacttctacacctccattacccgtgctcgatttgaggagttgaatgctgacctgttccgtggcacactggaccctgtagagaaggcccttcgagatgccaaactagacaagtcacagatccatgatattgtcctggtgggtggttctaccagaatccccaagatccagaaacttctgcaagacttcttcaatggaaaagagctgaataagagcattaaccccgatgaagctgttgcctatggtgcagctgtccaggcagccattctatctggagacaagtctgagaatgttcaggatttgctgctcttggatgtcactcctctttcccttgggattgaaactgctggtggagtcatgactgtcctcatcaagcgcaataccaccattcccaccaagcagacccagactttcaccacctactctgacaaccagccaggtgtactcatccaggtgtatgaaggtgaaagggccatgaccaaggacaacaacctgcttgggaagtttgagctcacaggcatacctccagcaccccgtggggttcctcagattgaggttacttttgacattgatgccaatggcatcctcaatgtttctgctgtagataagagcacaggaaaggagaacaagatcaccatcaccaatgacaagggccgcttgagtaaggaggatattgagcgcatggtccaagaagctgagaagtacaaagctgaggatgagaagcagagagataaggtttcctctaagaactcgctggagtcttatgctttcaacatgaaagcaactgttgaggatgagaaacttcaaggcaagatcaatgatgaagacaaacagaagattcttgacaagtgcaacgaaatcatcagctggctggataagaaccagactgcggagaaggaagaatttgagcatcagcagaaagaactggagaaggtctgcaaccctatcatcaccaagctgtaccagagtgctggtggcatgcctggaggaatgcctggtggcttccctggtggaggagctcctccatctggtggtgcttcttcaggccccaccattgaagaggtcgattaagtcaaagtagagggtatagcattgttccacagggacccaaaacaagtaacatggaataataaaactatttaaattggcacc

SEQ ID NO: 2186 - DNA, 5297 bp, Rattus norvegicus
  Genbank Accession No. NM_024353
gaattccgccgcgccgcaaacaggctcttacaggcgcgcacacagacacgcgcgcgcgcacacagcggggttcccggaggcggcggtggccgcatccccagcagcgactcgcctcgaagtgacaggagcctgctggctagtttctctgtgagtgctgaaaaccatttgagaggattctcaacaaagcaccctggggtctgtgcacaggattcgatcagctagacctcccttgctgctgcacctaaccatctggtcttgaacaccatcatggccaaaccttacgaatttaactggcagaaggaggtaccctctttcttgcaagaaggagcagtttttgacagatatgaagaggaatctttcgtgtttgagcccaactgcctcttcaaagtggatgaattcggcttcttcctgacctggaagagtgaaggcaaggaaggacaagtgctagaatgttccctcatcaacagcattcggctggcagccataccaaaggatcccaaaatcctggctgctctcgagtctgttggaaaatctgaaaatgatctggaagggcggatattgtgtgtctgcagcggcacggatctggtgaatattggcttcacttacatggtggctgaaaacccagaaataactaagcaatgggtagaaggcctgagatcaatcattcacaacttcagggcaaacaacgtcagtccgatgacatgcctcaagaaacactggatgaaactggcctttctgaccaacacaagtggcaaaatcccagtgaggagtattactagaaccttcgcatcagggaaaacagaaaaggtgatctttcaagcactcaaggaattaggtctccccagtggaaagaatgatgaaattgaacctgctgcatttacctatgaaaagttctatgaactgacacagaagatttgtcctcggacagatatagaagatctttttaaaaaaatcaatggagacaaaactgattatttaacggtagaccaattagtgagctttctaaacgaacatcagcgagatcctcggctgaatgaaattttattcccgttttatgatgctaaaagagcaatgcagatcattgagatgtatgaacctgatgaagagttgaagaaaaaaggcctcatatccagtgatggattctgcagatatctcatgtcagatgaaaatgcccccgtcttcctagatcgcttagaactttaccaggagatggaccaccccctggcccattacttcatcagttcctctcacaacacctatctcaccggccggcagtttggcggaaagtcttcagtggaaatgtaccgacaagtcctcctggctggttgcaggtgtgtggaacttgactgttgggatggaaaaggtgaagatcaggaaccaataataactcacggaaaagcaatgtgtacagacatcctttttaaggatgtaatccaggccatcaaggaaacagcgtttgtcacatcagaatatcctgtaattctctcctttgaaaaccactgcagcaaatatcaacagtaccagatgtccaagtattgtgaagatctatttggggatcttctgttgaaacaagcacttgagtcacatccacttgaaccagggaggctcttgccatctcctaatgacctcaaaagaaaaatactcatcaaaaataaaaggctgaagcctgaagttgaaaaaaaacagctggaggctttgaaaagcatgatggaggctggagaatcagctgccccggccagcatcttggaagatgacaatgaggaggaaatagaaagcgcagctgatcaagaggaagaagcccaccctgaatacaagtttggaaatgaactttctgccgatgacttcagtcacaaggaagcggttgcaaacagcgtcaagaagggcctggtcaccgtagaagatgagcaggcatggatggcatcttataaatacgtaggtgctaccacgaatatccatccgtacttgtccacgatgatcaactatgcacagcctgtgaagtttcaaggtttccatgtggctgaagagcgcaacattcattataacatgtcttcttttaacgagtcggttggccttggctacttgaagacgcacgcgattgagtttgtaaattacaataagcgacaaatgagccgcatttaccccaagggagggcgagttgattccagtaattacatgcctcagattttctggaacgctggttgccagatggtttcactgaactatcaaaccccagatttagcgatgcaattgaatcaaggaaaatttgagtataacggatcctgcggatacctcctcaagccagacttcatgagacggcctgatcggacatttgatcccttctctgaaacccctgtggacggggttattgcagccacatgctcagtgcaggttatatcagggcagttcctgtcagataagaagatcggcacatacgtggaagtcgatatgtacgggctgcccaccgacaccatacggaaggagttccgaacccgcatggttatgaacaatggactcaacccagtttacaatgaagaatcgttcgtgtttcggaaggtgatcctgcctgacctggctgtcctgagaatcgctgtgtacgacgacaacaacaagctcattggccagaggatccttcctctggatggcctccaggcaggttaccgacacatctccctgagaaatgagggaaacaaaccgttatcactgccaacaattttctgcaatatcgttcttaaaacatatgtgcctgatggattgggagatattgtggatgctctatccgatccaaagaaattcctttcaatcacagagaagagagcagaccaattgagagcaatgggcattgaaactagtgacatagcagatgtgcccagtgacacttccaaaaatgacaagaaaggcaaggccaacccagccaaagcgaatgtaacccctcagagcagctctgagctcagaccaaccaccacagctgccctgggatctggccaggaagccaagaaaggtattgaacttatccctcaagtgaggatagaagatttaaagcaaatgaaggcttacttgaagcatttaaagaaacaacaaaaggagttaaactctttaaagaagaaacacgcaaaggagcacagtaccatgcagaagttacactgcacacaagtggacaaaatcgtggcccagtatgacaaggagaagtcgactcatgagaaaatcctagagaaggccatgaagaagaaggggggaagtaattgccttgaaataaaaaaagaaacagaaattaagattcagaccctgacatcggatcacaaatctaaggtcaaggagattgtggcgcagcacacaaaggagtggtcagaaatgatcaacacgcacagcgccgaggagcaggaaatccgggacctgcacctgagccagcagtgtgagctgctgaggaagctgctcatcaacgctcatgagcagcagacccagcagctgaagctctcccatgacagggaaagcaaagagatgcgagcccatcaggctaagatttctatggaaaatagcaaagccatcagtcaagataaatctatcaagaataaggcagaacgggagaggcgagtcagggagttgaacagcagcaacactaagaagtttctagaagaaagaaagagactggcaatgaagcagtcgaaagaaatggatcagctgaaaaaggtccagctggagcacctagaattcctagagaaacagaatgagcaggcgaaggagatgcagcagatggtgaaattggaagccgagatggaccgcagaccagcaacagtagtatgaaactccagaatgcaaactgaagctggaagaccatagaacaccagaggatcacgcccagcttcagaggacagactccatggacaaaagctgttttcttttgtttttcttttatgtgtagacacggtgtaacctgaaaccacatggactggggatgaccaaatgttcttctacttaacaatttgactattgaatttctttggccaaccaaaagtagctatgtacacacacacacacacacacacacacacacacacacacacacacagaaatcccctattcctgacaggcagagttgaaccataatccacaacttaaacatgttggctaggggacagcatcacaagccagtgggcttggtgataacaactctgctttgtggtgcattaggacatgttcgagctgctgctggaaaaggaaaattagtgcattagtactttaatggcaagcgcatgcactagacgaaacaactccgtctacagtccattagcagaagtggtggtctgctatacaaatcactttgcagaactttctacacctaagttacctcatgagtaagtgccatgtctttaccatgccataagatgctaacttcctgtaaatgttgcagaatttgttaggacaatagagacacacaaaacggtgtacctgtgccaagctcatcagtgcgccaagggggactcagcaggctcgtttcggacagtttacagctgactctgctttgtaggaagtgcttctgcagatgcctcatgctgcaattcactacacactatcaggagggtggagtggctattggcaaatgtttgtaaatgtgaccatgtacaaagtatttatactccttaattctcatggttatagcgcaaagtcatctaaacattaccacacgacaagactagtaaacaggaatcatagatgttttgcatgatgcacaagcaccaattatgactaacccattgagacacagttaacctaacaccaaataaataccggttaagtcaatgtatggcacagaatattatttgactatcaagacttttagcataatgaaaaaagtctatatatatgtgtatatgaattatgtgggcattcttgatacttctagtttgaaaaaatacattaatttaattttacacaaaaatatttatgcagattttcagactttcatatcaggaaataacctttttatgtctgttaaatatccaaacgatttgctaccgtgttcatctgcatggtcttctcacctgctgtagttgccttgcaggtggtgcataaagtggacgggtgggatgagtcctgctgccccaacccagaggagcgtgcggagacccggtagcctaggagtcagattcctgattttaggatgcaaaacgccaacttaattgttgtatatggttgtacaaatagattctgtgtgttcctctgaggagggcagagaagagtatgataccatgaaggctgaaattcaacgtacaacttctctaataaaaaaaaaaaaaaaaaaa

SEQ ID NO: 2187 - DNA, 1016 bp, Rattus norvegicus
  Genbank Accession No. NM_024356
gacttcgaacctcattcggtgcagaactcctgtcccggtgacagccacaggtcacggccgccggctaagccgagccgcagcgcttggtagcaccttagggtgtctcgggagcaatcgcgccgggtccatggagaagccgcggggtgtaaggtgcaccaatgggttccccgagcgggagctgccgcggcccggggccagccgacctgccgagaagtcccggccgcccgaggccaagggcgcacagccagccgacgcctggaaggcagggcggccccgcagcgaggaggataacgagctgaacctccccaacctggcggccgcttactcgtccatcctgcgctcgctgggcgaggacccccagcggcaggggctgctcaagacgccctggagggcggccaccgccatgcagttcttcaccaagggataccaggagaccatctcagatgtcctgaacgatgctatatttgatgaggaccatgacgagatggtgattgtgaaggacattgacatgttttccatgtgtgagcatcacctggtcccatttgtgggaagggtccatattggttatcttcctaacaagcaagtccttggtctcagcaaacttgccaggattgtggaaatctacagtagaagactacaagttcaagaacgccttaccaaacagattgcagtggccatcacagaagccttgcagcctgctggcgtcggggtagtgattgaagcaacacacatgtgtatggtcatgcgaggtgtgcagaaaatgaacagcaagactgtcactagcaccatgctaggcgtgttccgggaagacccaaagactcgggaggagttcctcacactcatcaggagctgaacttccgtgtgcgagccccggtttgcagacccccgctgaggccagcgttatctgtctcgattgtacattccagttccagttggtatacttgtcaactttatttctcaccatgaattgtatttaataattatttatagagatgtcaaataaaggtgatcaactt

SEQ ID NO: 2188 - DNA, 3718 bp, Rattus norvegicus
  Genbank Accession No. NM_024359
gacaccgcgggcaccgattcgccatggagggcgccggcggcgagaacgagaagaaaaataggatgagttccgaacgtcgaaaagaaaagtctagggatgcagcacgatctcggcgaagcaaagagtctgaagttttttatgagcttgctcatcagttgccacttccccacaacgtgagctcccatcttgataaagcttctgttatgaggctcaccatcagttacttacgtgtgaggaaacttctaggtgctggtgatcttgacattgaagatgaaatgaaagcacagatgaactgcttttatctgaaagccctggatggctttgttatggtgctaacagatgatggtgacatgatttacatttctgataacgtgaacaaatacatggggttgactcagtttgaactaactggacacagtgtgtttgattttacccatccatgtgaccatgaggaaatgagagaaatgcttacacacagaaatggcccagtgagaaaggggaaagaacaaaacacgcagcgaagcttttttctcagaatgaaatgtaccctaacaagccgggggaggacgatgaacatcaagtcagcaacgtggaaggtgctgcactgcacaggccacattcatgtgtatgataccagcagtaaccagccgcagtgtggctacaagaaaccgcctatgacgtgcttggtgctgatttgtgaacccattcctcatccatcaaacattgaaattcctttagacagcaagacatttctcagtcgacacagcctcgatatgaaattttcttactgtgatgaaaggattactgagttgatgggttatgagccagaagaacttttgggccgttcaatttatgaatattatcatgctttggactctgatcatctgaccaaaactcatcatgacatgtttactaaaggacaagtcaccacaggacagtacaggatgcttgcaaaaagaggtggatatgtctgggttgagactcaagcaactgttatatataatacgaagaactctcagccacagtgcattgtgtgtgtgaattatgttgtaagtggtattattcagcacgacttgattttctcccttcaacaaacagaatctgtcctcaaaccagttgaatcttcagatatgaaaatgacccagctgttcactaaagtggaatctgaggacacgagctgcctcttcgacaagcttaagaaagagcccgatgccctgactctgctagctccagcggctggggacacgatcatatcactggacttcggcagcgatgacacggaaactgaagaccaacaacttgaagatgtcccgttgtacaatgatgtaatgttcccctcttctaatgagaaattaaatataaatctggcaatgtctccattacctgcctctgaaactccaaagccacttcgaagtagtgctgatcctgcactgaatcaagaggttgcattgaagttagagtcaagcccagagtcactgggactttcttttaccatgccccagattcaagatcagccagcaagtccttctgatggaagcactagacaaagctcacctgagcctaacagtcccagtgagtactgctttgatgtggacagcgatatggtcaatgtattcaagttggaactggtggaaaaactgtttgctgaagacacagaagcgaagaatccattttcagctcaggacactgatttagacttggaaatgctggctccctatatcccaatggatgatgatttccagttacgttcctttgatcagttgtcaccattagagagcaattctccaagccctccgagtgtgagcacagttacaggattccagcagacccagttacagaaacctaccatcactgtcactgccaccgcaactgccaccactgatgaatcaaaagcagtgacgaaggacaatatagaagacattaaaatactgattgcatctccaccttctacccaagtacctcaagaaatgaccactgctaaggcatcagcatacagtggtactcacagtcggacagcctcaccagacagagcaggaaagagagtcatagaaaaaacagacaaagctcatccaaggagccttaacctatctgtcactttgaatcaaagaaatactgttcctgaagaagaattaaacccaaagacaatagctttgcagaatgctcagaggaagcgaaaaatggaacatgatggctccctttttcaagcagcaggaattggaacgttactgcagcaaccaggtgaccgtgcccctactatgtcgctttcttggaaacgagtgaaaggatacatatctagtgaacaggatggaatggagcagaagacaatttttttaataccctctgatttagcatgtagactgctggggcagtcaatggatgagagtggattaccacagctgaccagttacgattgtgaagttaatgctcccatacaaggcagcagaaacctactgcagggtgaagaattactcagagctttggatcaagttaactgagcttttcctaatctcattcctttgattgttaatttttgtgttcagttgttgttgttgtctgtggggtttcgtttctgttggttgttttggacactggtggctcagcagtctatttatattttctatatctcatttagaggcctggctacagtactgcaccaactcagatagtttagtttgggccccttcctccttcattttcactgatgctctttttaccatgtccttcgaatgccagatcacagcacattcacagctccccagcatttcaccaatgcattgctgtagtgtcgtttaaaatgcacctttttatttatttatttttggtgagggagtttgtcccttattgaattatttttaatgaaatgccaatataattttttaagaaggcagtaaatcttcatcatgatgataggcagttgaaaattttttactcatttttttcatgttttacatgaaaataatgctttgccagcagtacatggtagccacaattgcacaatatattttcttaaaaataccagcagttactcatgcatatattctgcatttataaaactagtttttaagaagaaactttttttggcctatggaattgttaagcctggatcatgatgctgttgatcttataatgattcttaaactgtatggtttctttatatgggtaaagccatttacatgatatagagagatatgcttatatctggaaggtatatggcatttatttggataaaattctcaattgagaagttatctggtgtttctttactttaccggctcaaaagaaaacagtccctatgtagttgtggaagcttatgctaatattgtgtaattgatattaaacattaaatgttctgcctatcctgttggtataaagacattttgagcatactgtaaacaaaaaaatcatgcattgttagtaaaattgcctagtatgttaatttgttgaaaatacgatgtttggttttatgcactttgtcgctattaacatcctttttttcatatagatttcaataattgagtaattttagaagcattattttagaaatatagagttgtcatagtaaacatcttgtttttttttctttttttctatgtacattgtataaatttttcattcccttgctctttgtagttgggtctaacactaactgtactgttttgttatatcaaataaacatcttctgtggaccaggaaaaaaaaaaaaaaaaaaaaaaaaaaa

SEQ ID NO: 2189 - DNA, 1929 bp, Rattus norvegicus
  Genbank Accession No. NM_024365
tagccaggaaccccacccccatcttatggcatccccggtggccctattccatcccagggctctcatccagccccaagctaactttcattgactcgtcacatcagtacccctccccaaacttcttacccgagtactccaggtggccctgccgtaggaggcacccctacaactcctcccgatctcttgaaatcgctgctcgatgacctaagaaccccgttttgccaatactactctaaggtgcagcttcctttctcctcctttgccttcaccctgtacctgcagtcaccatatcccgtcttggtcctcaacccagtccccatggttccagagccaggccctgtcaacagtagcaccccagcctggggtcccgggccaccgcctgctccggggggcagcggctgggtggctgccgcgctgtgcgtggtcatcgtgctgacagcagccgccaattcgctgctgatcgtgctcatttgcacgcagcccgcgctgcgcaacacgtctaacttctttctggtgtcgctcttcacgtcggacttgatggtggggttggtggtgatgcccccagccatgctgaacgcgctgtatgggcgctgggtgttagctcgaggcctctgtctgctttggactgccttcgacgtgatgtgctgcagcgcctccatcctcaacctctgcctcatcagcctggaccgctacctgctcatcctctcgccgctgcgctacaagctgcgcatgacagccccgcgagccctggcgctcatcctgggtgcctggagcctcgcggcgcttgcctccttcctacccctcttgctgggctggcacgaactgggcaaagctcgaacacctgcccctggccagtgccgcctattggccagcctgccttttgtcctcgtggcgtccggcgtcacctttttcctgccttcgggtgccatctgcttcacctactgcaggatccttctggctgcccgcaagcaggcggtgcaagtggcctcgctcaccacgggcacggctggccaggccttggaaaccttgcaggtgcccaggacaccacgcccagggatggagtccgctgacagtaggcgtctggccaccaagcatagcaggaaggccttgaaggccagcctgaccctgggcatcctgctgggaatgttctttgtcacctggctgcccttctttgtggccaacatagctcaggccgtgtgtgactgcatctccccaggcctcttcgatgtcctcacatggctggggtactgtaatagcaccatgaaccctatcatctacccgctctttatgcgggacttcaagagggccctgggcaggttcctgccatgcgtccactgtcccccggagcaccggccagccctgcctccccctccatgtggacctctcacagcggtgccagaccaggcctcagcctgcagcaggtgctgcctctgcctctgccgccaaactcagattcagactccgcttcagggggcacctcgggcctgcagctcacagcccagcttctgctgcctggagaggccacccgggaccccccgccacccaccagggccaccactgtggtcaacttctttgtcacagactctgtggagcctgagatacggccgcatccactcagttcccccgtgaactgaccaggtcaagagctggccattggaggccacattcccggagctctcagcccactctccctgagactaggaggtggtaggtctcctgagagtgtgctgaattgaggtatcctcagctagccccatcttctgctgcaggctccttgacctgaggggtagtcagaaacatctctgtggggtactccagtgcaatgttgcttgtgtagtgtggctgggaggggggcggtctcagagccgggccatttggttcaggtcagtaggaaagcaatctgtcctcatccctttctctcatggtggg

SEQ ID NO: 2190 - DNA, 1370 bp, Rattus norvegicus
  Genbank Accession No. NM_024369
ctggcctccaactcactgcttccatcctgcccagtgtcctctcgagtcccggacccgagcacgatgtggaaacgctggctggcgctcgcgctggtgaccatcgccctggtccacggcgaggaggaacaaagaagcaaatccaagatctgcgccaatgtgttttgtggagctggccgggaatgcgccgtcacggagaagggggagccaacgtgcctctgcattgagcaatgcaaacctcacaagaggcctgtgtgtggcagtaatggcaagacctacctcaaccattgtgaacttcacagagacgcctgcctcactggatccaagatccaggttgattatgatgggcactgcaaagaaaagaagtctgtgagtccatccgccagccccgttgtctgctatcaggctaaccgtgatgagctgcggcgccggatcatccagtggctggaagccgagatcattccagatggctggttctctaaaggcagtaactacagtgagatcctagacaagtactttaagagctttgataatggtgactctcacctggactccagcgaattcctgaaattcgtggagcagaatgaaacagccgtcaacatcaccgcttaccccaatcaggagaacaacaaactgctcagaggcctctgtgttgatgccctcattgaactgtccgatgagaacgctgactggaaactcagcttccaagagttcctcaagtgcctcaacccatccttcaaccctcctgagaagaagtgcgccctggaggacgaaacctatgcagatggagctgagaccgaggtggactgcaatcgctgtgtctgttcctgtggacactgggtctgcacagcgatgacctgtgatggaaagaatcagaagggggtccagacccacacagaggaggagatgacgagatatgcccaggaactccagaagcaccagggaacagcagaaaagaccaagaaggtgaacaccaaagagatctaagaagaggcacgtagcacctcatctggaacccagcacctcctcttcagcgctaagcccagtatacagcgtctgtggcaatcaccgaatcaccagtatttgcttgtacggcagcaaatcttatctgtttgttttgcaataaaggaagtgagggtggctggctagccagggcaggcaggccacaactttcacttctaggaatgctttaagagacactaaagggcaccttggggcaggaggcgagtatccggttggcagaggagcagaggcaggtctgaatgaaacctttctggggtcagctgtgaggatacaacaggaaaagcatgtgatgttagggggaacactgagctggccctgctggaggaaatagggggagcttggtggggagg

SEQ ID NO: 2191 - DNA, 2411 bp, Rattus norvegicus
  Genbank Accession No. NM_024375
gccggcgcgggctcggctgagctccacgcggctcaggacagccgtgaccactgaccgggcggcgtggatgctcagcaagcagctctgccaccgcgagccaatcccgatacatcgagtcgggtcgtcggggctgtccgagtccccacagacactccagccgtggaccaggtgcacagccaacactgagccttccctgtctgccctcctgggctcagacccttcaccactgtcactcagccatggctccaggtcttgctcggatcagcttgaggtctcagctgctgcccttggtgccgctgctcctgctactgcggggcgcaggctgcggccacagagtcccctcatggtcctcactgccttcagcagctgacagtgtgcagagggacagggacctccagcagtcacccggggacgctgcagccgctctgggtccaggcgcccaggacatagtcgctgtccacatgctcaggctctatgagaagtacaaccggagaggcgctccaccaggaggaggcaacaccgtccgaagcttccgtgcccggctggatgtgatcgaccagaagcctgtgtatttcttcaacttgacttccatgcaagactcagaaatgatcctcacagccaccttccacttctactcagaacctccacggtggccccgggctcgtgaggtattctgcaagccccgagctaagaatgcatcctgccggctcctgaccccaggtctgcctgctcgcttgcacctaatcttccgcagtctctcgcagaacactgccactcaggggctgctccgcggggccatggccctgacacctccaccacgtggcctctggcaggccaaggacatctcctcaatcatcaaggctgcccgaagggatggagaacttcttctctctgctcagctggattctggagagaaggatctcggagtgccacggcccagttcccacatgccctatatccttgtctatgcaaatgacctggccatctcggagcccaacagtgtagcagtgacgctacagagatacgacccatttccagctggagactttgagcctggagcagcccccaacagctcagcggatccccgcgtgcgcagggcggcacaggtatccaaacccctgcaagacaatgaacttccagggctggacgaaagaccagcgcctgccctgcacgcccagcatttccacaagcacgagttctggtccagtcctttccgggcactgaaaccccgcaccgggcgcaaagaccgcaagaagaaagaccaggatacattcaccccctcctcctcgcaggtgctggactttgatgagaagacgatgcagaaagccaggaggcggcagtgggatgagcctcgggtctgctccaggaggtacctgaaggtggattttgcagacatcgggtggaatgaatggatcatctcacccaaatcctttgatgcctactactgtgctggagcctgcgagttccccatgcccaagatcgtccgcccgtccaaccatgccaccatccagagcatcgtcagagctgtgggcattgtccctggcatcccggagccatgctgtgtcccagacaagatgaactcccttggagtccttttcctggacgagaatcggaatgtggttctgaaggtgtaccccaatatgtccgtagagacctgtgcctgtcggtaaggtggcttcaagatggaaggcagacctccttcacccctgctgtgcagagtggcattcttggagccaggatttgactcgagcaagtcccaggtgctagacggagcttatagacagccaggctgagaccaagatctgtccaccgagccacagttctcccgttcttccgcgtcgtggtagctctgtaaggacttttttgagttcctggaaggaatctggaattcaccatggtctgaaatttgcccacatttttcaaggcctagaaatagcatgtgtccacagatgtcaaccccaaggcatctgtcctctcagaacctggaaagactatgcaaatctcggggcactccccgccccccacggcagtaaatgcttatttgaaaaccctcaagcggcatactagaaacagggcctaaagcatggcatggatgggtatttctcttacatttcactacacatgcttttatacatgcagtacgcaacatgtactcgagactgatttcttcttttaatatatgtattttgatttcaaagcaaagtggacagagttgacccccatgccccacagacgtaatactgaaagttaggtgtgggctgtttaaacatgcgtatgaaaaataatacagtgatatgctggaatactaaaaaataaccaagattctatatttttgtaaattatactttgtatactgtagattgtgagtgttctgtgtttttatggaaagctaataaattaaaggtacagtg

SEQ ID NO: 2192 - DNA, 592 bp, Rattus norvegicus
  Genbank Accession No. NM_024383
cctggctctgctcgctccgctccgctcgccaatcgcctccagagctccaggcatggccccaagtaccgtggcggtggagatgctcagtcccaaggagaaaaatcgactgcggaagccggtggtggagaagatgcgtcgggaccgcatcaacagcagcattgagcagctgaaactgctgctggagcaggagttcgcgcggcaccagcccaactccaaactggagaaggccgacatcctggagatggccgtcagctacctgaagcacagcaaagccttcgccgcggccgccggccccaagagcctgcaccaggactacagcgagggttactcgtggtgcctgcaggaggcggtgcagttcctgaccctgcatgcagccagcgacacgcagatgaagctgctttaccacttccagcggcccccagctcccgccgcgcctgtcaaggagaccccgacgcccggcgctgcgccccagccggcgcgctcctccactaaggccgccgcctccgtctccacctcgcgccaatctgcctgcggcctctggcggccctggtgacccagcggccgacgggtgcctggagctgaccagaggacc

SEQ ID NO: 2193 - DNA, 1390 bp, Rattus norvegicus
  Genbank Accession No. NM_024386
gagactccgggcgaagatggcgacagtgaggaaggctttcccacagaggctggtgggcttggcgtccctccgggctgcgagcacctcctccatgggcaccttgccgaagcgggtgaagatcgtggaagtcggcccccgagatggtctgcagaatgaaaagagtatcgtgccgacgccagtgaaaatcaaactgatagacatgctatccgaagcagggctcccggtcatcgaggccaccagctttgtctctcccaagtgggtgccgcagatggctgaccactctgacgtcttgaagggcattcagaagtttcccggcatcaactacccggtcctgacaccaaacatgaaaggctttgaggaagcggtagctgcaggtgccaaggaagtgagcatctttggggctgcgtccgagctcttcacccggaagaatgtgaactgctctatagaggagagtttccagcgctttgatggggtcatgcaggccgcgagggctgccagcatctctgtgagagggtatgtctcctgtgccctcggatgtccctacgaggggaaggtctccccggctaaagttgctgaggtcgccaagaagttgtactcaatgggctgctatgagatctcccttggggacaccattggcgtaggcacgccaggactcatgaaagacatgctgactgctgtcctgcatgaagtgcctgtggccgcattggctgtccactgccatgacacctatggccaagctctggccaacacgttggtggccctgcagatgggagtgagcgttgtggactcctcggtggcaggactcggaggctgtccctatgcaaagggggcgtcaggaaacttggctaccgaggacctggtctacatgctgactggcttagggattcacacgggtgtgaacctccagaagctcctagaagccggggacttcatctgtcaagccctgaacagaaaaaccagttccaaagtggcacaggccacctgcaaactctgagccccttgttcacctaaaccggaactgtgggagttgggtgtacacaatgattcctggatggggaaatggaatgaaggcaaatgagccggcctcacagaggtccctctcctacatagaagggctagagctgccagcacgcccggaccagctccccagagctgcgtgcctaagcactgcttggctggccctgggtgagtccactagccagcagagctgacatccatgtgccacgaccgcgggtcccatgttctacctctgaggacagcagcgcctttgctgaaatggtgggctcaatctactgcggtggccgactgccaactccagcgtctctgggaaatctctgtacgtgattcttgaaaacagcttatgtaattaaaggtttaattttctaatatc

SEQ ID NO: 2194 - DNA, 2488 bp, Rattus norvegicus
  Genbank Accession No. NM_024388
gcgaaagttggggtagtgtgcgagaaggattgcagagcgcacgcggaaccagactgcgactgggtcctgggtcgctggtcccggccacggggagcgggagccggccggagatgccctgtatccaagctcaatatggaacaccagcaaccagcccaggaccgcgtgaccacctgacaggtgaccccctggcccttgagttcagcaagcccaccatggacctggccagccccgagacggcgcccaccgcacctgccaccctgcccagtttcagcaccttcatggacggcggatacaccggagagtttgacaccttcctataccagctgccggggacagcccagccgtgctcctcggcctcctccacatcttcttcctcgtcctcggccacctctcccgcgtcggcttcctttaagtttgaggactttcaggtgtatggctgctaccctggcaccctgagcggcccattagacgagaccctgtcctccagtggctctgattactatggaagcccctgctcagccccgtcaccacctacacccaacttccagccatcccagctctccccttgggatggttcatttggccacttctcccccagccagacttatgaaggccttcgggtatggactgagcagttgcccaaggcttccgggcctccgccacctccaaccttcttctccttcagtcctcccaccggtcccagccccagcctggcccagagttccctgaagttgttcccagcaccagccacccaccagctaggggagggggagagctattccgtgccagccgctttcccgggcttggcacccacctctccgaactgtgacacttccggcattctggacgcacccgtaacctccaccaaggcccgcagtgggtcttcagggggcagtgagggccgctgtgctgtctgtggagacaacgcttcgtgccagcattatggggtccgcacctgtgagggctgcaaaggcttcttcaagcgcacagtacagaaaagtgccaagtacatctgcctggcaaacaaggactgccctgtggacaagaggcggcggaaccgctgccagttctgtcgcttccagaagtgcctggctgtgggcatggtgaaggaagttgtccggacagacagcctaaaggggcggcggggccggctaccttcaaaacccaagcagcccccagatgcctcccctaccaatctcctcacgtccctcattcgagcacatttggactccgggcctaacactgccaagttggactattccaagttccaggaactggtgctgccccgctttggaaaggaagatgccggtgacgtgcagcaattttatgacttgctctctggctccctggacgtcatccggaagtgggcggaaaagatcccgggcttcattgagctttccccaggagaccaagacctgttgctagagtccgcctttctggagctctttatcctccgcctggcctaccgatctaagcccggtgaggggaagctcatcttctgctcaggcctggtgctacaccggctgcagtgtgcccgcggctttggtgactggatagacaacattctagccttctcacggtccctgcacagcttgggtgttgatgttcctgcctttgcctgcctgtctgctctggtcctcatcactgatcgacatggcctccaggaccctcggcgggtggaggagctgcagaaccgcattgctagctgtctgaaggaacacatggccgccgtggcaggagacccacagccggccagctgcctgtcacgtctgctgggcaaactgcctgagctccggactctgtgcacccaaggcctacagcgcatcttttgcctcaagctggaggacttggtgccccctccacctatcgtggacaagatctttatggacaccttgtctttctgaccctgccccgaacacgcgtgcacactcacgtgcatgttcttcttgtcacccacgtgcctttaagcccatagcccacggacccccagaccaccccaccccccagcctgttttttgagctaagactgatgtatctcctcattccagaagatggacagagagagagagagagctcaagacctgggggggagggtgtgtattcacgggggtgaccccactatttctcttatccctcccagctcagacctggccttccgcgtgtttttgtaagataaaccatttttaacacataccactctgctgtatataagctgacgctgctgtaaatacagaaaggaagaggtcggggtgggggtttgagaggaagggtgggccccccaaccccgccagctgggcaagcctctcgagcctccaacttgagatctcttccgctctccttccatgtgtacatagctgtcactcaagaaggtgattgacagattctgatttatatttgtgtatttttttcctggatttataggatgtgactttttctgattaatatatttaatatattaaataaaaactagacatgtagctgaaaaaaa

SEQ ID NO: 2195 - DNA, 2535 bp, Rattus norvegicus
  Genbank Accession No. NM_024392
gagcagtaccccggccactgccagtgtgtgcgtggtgcaggatagactcatggcttcgcctctgaggttcgacgggcgtgtggtcctggtcaccggcgccgggggagggttgggcagagcttatgccctggcttttgcagaaagaggagcattagttgttgtgaatgacttaggaggggacttcaaaggcgttgggaaaggctcttctgccgcagacaaggtcgtggaagaaataagaaggagaggcgggaaagcggtggccaattacgattcaggcgaagcaggcgagaagcttgtgaagacagcactggacacattcggcagaatagatgttgtggtgaacaatgctgggatcctgagggaccgttccttctctaggataagtgatgaagactgggatataattcaaagagttcatttgcggggctccttccaagtgacccgggcagcatgggatcatatgaagaagcagaattatggaagaatcattatgacggcctcagcttctggaatatacagcaactttggccaggcaaattatagtgctgcaaagctgggccttctgggtctcgccaatactctcgtgattgaaggcaggaagaacaacattcattgtaacaccattgccccaaacgctgggtcacggatgacagagacggtgatgccagaagacctcgttgaagccctgaagccagagtatgtggcaccgctggtcctttggctttgccatgagagctgtgaggaaaatggtggcttgtttgaggttggagcaggatggattggaaaattgcgctgggagaggaccctgggagccattgtcaggaagcggaatcagcccatgactcccgaggcagtgagggacaactgggtgaagatctgtgacttcagcaatgccagcaagccgaagagcattcaagagtccacaggtggtataatcgaagttttacataaaatagattcagaaggaatctcacaaaatcacaccggtcaagtggcatctgcagatgcatcaggatttgctggcgtcgttggccacaaacttccttcattttcttcttcatatacggaactgcagtgcattatgtatgccctcggagtaggagcttcagtcaaaaatccaaaggacttgaagtttgtttatgaagggagtgctgacttctcctgtttgcctacatttggagtcattgtcgctcagaagtccttgacgagtggaggcttagcagaggttcctgggctgtcaatcaactttgcaaaggttcttcatggggagcagtacttggagttgtataagccacttccccgatcaggggaattaaaatgtgaagcagttattgctgacatcctggataaaggctctggcatagtgattgttatggacgtctattcttattctggcaaggaacttatatgctataatcagttctctgtcttcgttgttggctctggaggctttggtggaaaacggacatcagaaaaactcaaagcagctgtagccgtaccggatcggcctccagatgctgtactgagagataccacttcactgaatcaggccgctctgtaccgcctcagtggagactcgaatcctttacacattgacccgagctttgcgagcattgccggttttgagaaacccatattacacggattatgtacttttgggttttctgcaaggcatgttttacagcagtttgcggataatgatgtgtcaagattcaaggccattaaggttcgttttgccaaaccagtgtatccaggacaaactctacaaactgagatgtggaaggaaggaaacagaattcattttcaaaccaaggtccaagagactggagacattgtcatttccaatgcatatgtggatcttgttcctacatctggagtttccgctcagacaccttctgagggtggagcactgcagagtgctcttgtatttggggaaataggtcgacgcctcaaggatgttggacgtgaggtggtaaagaaagtaaatgctgtatttgaatggcatatcacgaaaaatgggaatgttgcagccaagtggaccattgacctgaagaacggctctggagaggtttaccaaggccctgccaaaggctctgctgacacgaccatcacaatttctgatgaggatttcatggaagtggtcctgggcaagcttaacccacagaatgccttcttcagtggcagactgaaggcccgaggaaacatcatgctgagccagaagctacagatgattctgaaagactatgccaagctctgaaggacccactgcgtgctttaataaaaccagaatcattacgttctgtctacgcagtcatgctccagccttctttgaaacgatccacggtaatgtgcagcagaaatcgcttaacattttcagattcagataactttcagattttcattttctactaatttttcacatattatttttataaggaactgtaatctagctagcaaataattgttctgttcatagatctgtatcttaataaaaaaaaagtcaaccgaaaaaaaaaaaaaaaaaaaaaaaaaaaa

SEQ ID NO: 2196 - DNA, 4878 bp, Rattus norvegicus
  Genbank Accession No. NM_024400
ctgtcactaggcctgagcgcacagcccggcggagagagcagatccttgctcagtatccagccctatcgcggccaaggcggaggacgaagagtccaggctcttattctggacttgttccccaattccagggcgcttctcgatcctgcagcagcctcttagcagctccagcagtgcggagccattaactcggtgctggaataaaaaaaattcccgcgcgccggcgcagcctttttctaagtgacccggagcttttggctgcgagctctgcaagaactttcaaatcaaagtgcttgtgaattttaagcatccggagcaggccaacgaagctctgcgcgtctaaccgtctaaccgtctaaccagaacaagagttctctgcgctgcagtgtgcggtgtcatgcagccagaagtccctttggggtcaggcaagctgaagccctgctcagacatgggggacatccagcgggcagcgaagtttcggagctctcagtctgcacacatgctgttgctactcctcgcttccataacaatgctgctgtgtgtgcggggcgcacacgggcgccccacggaggaagacgaggagctggtgctgccctcgctggagcgcgcccggggccacgattccaccacactcctccgtctggacgcctttggtcagcagctgcatctgaagttgcagccagacagcggtttcttagcgcctggcttcaccctccagacggtggggcgcagtcctgggtccgaggcacagcatctggaccccactggggacctggcccactgcttctactctggcacggtgaacggtgaccccagctccgccgccgccctcagcctctgtgaaggtgtgcgcggtgccttctacctacaaggcgaggagttcttcattcagccagcgcctgcggtggccaccgagcgcctggtccccgccgaaccgaaggaggagtcaatcgcacctccgcggttccacatcctgaggcgaaggcggcggggcagcggcggcgcaaagtgcggtgtcatggacgaagagaccctgccaaccagcaactcgggtcgcgaaagccagaacaccccggaccagtggcctctgcggaaccccactcctcagggcgcgggaaagccaacaggaccaggaagcataaggaagaagcgatttgtgtccagcccccgttatgtggaaaccatgctcgtggctgaccagtccatggctgacttccacggcagcggtctaaagcattaccttctaaccctgttctcggtggcagccagattttacaagcaccccagcattaggaattcaattagtctggtggtggtgaagatcttggtcatatatgaggagcagaagggaccggaagttacttccaatgccgctctcacccttaggaatttctgtagctggcagaaacagcacaacagccccagtgaccgggatccagagcactatgacacagcgattctgttcaccagacaggatttatgtggctcccacacctgtgacactctcgggatggctgatgttggaactgtatgtgaccccagcaggagctgttcggtcatcgaagatgatggtttacaggctgccttcaccacagcccatgaattgggccatgtgtttaacatgccacacgatgacgccaagcactgcgccagctttaatggcgtgagtggggattcccatctgatggcctcgatgctctccagcttggaccacagccagccctggtctccttgcagtgcctacatggtcacatcattcctggacaacggccatggggaatgtttgatggacaagccgcagaacccaatcaagctcccatctgatcttcccggtaccttgtacgatgccaaccgccagtgtcagtttaccttcggggaggaatccacgcactgccctgatgcagccagcacatgcagtaccctgtggtgcactggcacctccggtggcttactggtgtgccaaacaaaacacttcccttgggcagatggcaccagctgcggagaagggaaatggtgtgtcagcggcaagtgtgtgaacaagaccgacatgaagcactttgctactcctgttcatgggagctggggaccgtggggaccatggggagactgctcaagaacctgtggtggaggagttcaatatacaatgagagaatgtgacaacccggtcccaaagaacggggggaagtactgcgaaggcaaacgagtccgctacaggtcctgtaacattgaggactgtccagacaataacggaaaaacattcagagaggagcaatgcgaggcgcacaatgagttttccaaagcttcctttgggaatgaacccacggtggaatggacacccaagtatgctggcgtctcgccaaaggacaggtgcaagcttacctgcgaagccaaaggcattggctacttctttgttttacagcccaaggtggtagatggcactccctgtagtccagactctacttctgtctgtgtgcaaggacagtgtgtgaaagctggctgtgatcgcatcatagactccaaaaagaagttcgataagtgtggcgtttgtggaggaaatggctccacgtgcaagaaaatatcaggaacggtcactagtacaagacctgggtatcatgacattgtcacaattcctgctggagccaccaacattgaagtgaaacatcgtaatccaaggggatccagaaacaatggcagctttctggctattagagctgcagatggtacctatattctgaatggaaacttcactctgtccactctagagcaagacctcacctacaaaggtactgtcttaagatacagtggttcctcagcagcattggaaagaatccgcagctttagtccactcaaagaacccctgaccatccaggttcttatggtgggccatgctctccgacccaaaatcaagtacacctattttatgaagaagaagacggagcccttcaacgctattcccacattttcggagtgggtgattgaagagtggggggagtgctccaagacatgtggttccggttggcagaggagagtggtagagtgcagagacattaatggacaccctgcttctgaatgtgccaaagaagtgaagccagccagtaccagaccttgtgcagaccttccttgcccacgttggcaggtgggggattggtcaccatgttctaaaacttgtgggaagggttataagaagagaaccttgaaatgtctgtcccatgatggcggtgtgttatcaaatgagagctgtgatcctttgaagaaaccaaagcattacattgacttttgcatactgacacagtgcagttaagaggttttgaggacaaggtagcgtgggagggctgatacactgaaagcaagagtgctggagggatcctgtgaatcaaaccagtaaacagtgaggtgtggcaatgaggtgtgtataggggatacattagcaaaagaggtagatccgtacactatcctgccagttaacttctgatagggtagttaatgaggaatagtagcatctgaaagatcatacatagcactatgaagccccaaagtactattagtattccttttgttacatccactgcacaaataattttcagagtctggcagaagcatggctaccctgttgcatggtactaattaatactttgtatcacaggggttgggaaaggaaagcagaagaatggtaagattggatttcaaacatggcttacttttttatcactggaggcagggagaagggtacaaacaagatcattattcaaagtttctggctgccgtggtttcagggaaggttgattcctatcaagagtgaaaagttctgattgctcaacatgagagagagaaagcctcgtctctgtgaaataactcttgatttcttcttagaccatctccgttttttaaccataattcctgttgaggtagtaacaattcacctacttataaaatgtacattgggtgggaaaaagtgaagtataagagttacacataaaaactcaaggaataagcaacatggctcctgctttgctttctcctaaggttagcctgcctgggatctgtggacgttaaagataatccttgactcacaaaaggcagtaaaaccatacatgtcatgcaagagtaagaatgggctatagagatcagggtcccatgagatgggggacacggaggtcactcatctcacatgggagactgctgcaggatagcaggtccactcctggcagctggtccaacagtcgtatcctggtgaatgtctgttcagctcttttactgagagagaatatgactgtttccatatgtatatagtaaaatacattactatgatttatatgtactttataagtattggtttgtttgttccttctaagaaggactatagtttataataaatgcctataacatatttatttttatacatttatttctaatgataaaaccttttaagttatatcgcttttgttaaagtgcatataaagatagagtatttatacaatatatgttaactagaaataataaaagaacacttttgaatgtgtttgcctattttctgaagtgggcttaactcctgggcaagaaatctaatgagacacaagcattggatttcaggacagctttaaaatctgggtgaatgaactgtatttcctgtttatagacatactaataaaaaagaagttgatgatgtctttagtgataagattgttactaacgtggttggcaaattactgtaaagagtcagatagtaagcgtttatggcattgtaggctatatttcctgccacaaccctgtgacagtgaatgctttgtaggaatgagagcagccataaatgacatgtacaccatagctgtgctttaataaaaccttatttgcaaaaaaaaaaaaaaaaaaaaaaaaaaaaaa

SEQ ID NO: 2197 - DNA, 1173 bp, Rattus norvegicus
  Genbank Accession No. NM_024403
tcgagttaagcacattcctcgataccagcaaatccctacaacatgaccgagatgagcttcctgaacagcgaagtgttggcgggggacttaatgtcccccttcgaccagtcgggtttgggggctgaagaaagcctaggtctcttagatgactatctggaggtggccaagcacttcaaacctcatgggttctccagcgacaaggcgggctcctcagaatggctggctatggatgggttggtcagtgcctcagacaccggcaaggaggatgccttttccgggacagattggatgttggagaaaatggacctgaaagagtttgacttcgatgctctgtttcgaatggatgacctggaaaccatgccagatgagcttttggccacgttggatgacacatgtgatctttttgcccctctagtccaagagactaataaggagccccctcagacagtgaacccaattggccatctcccagaaagtgtaataaaagtcgaccaggctgccccctttacattcttgcagcctcttccctgttccccagggtttctgtcttccactccagatcattcctttagtttagagctgggaagtgaggttgatatctctgaaggagataggaagcctgactctgctgcttatattactctaacccctcagtgtgtaaaggaggaagacactccctctgatagtgacagtggcatctgtatgagccctgagtcctacctgggctctccccaacacagcccttccacctccagggccccaccagacagtctgccttctccaggtgttcctcgtggttctcgacccaaaccttatgacccacctggagttagtgtgacagctaaagtgaagactgaaaagttggataagaagctgaaaaagatggagcaaaacaagacagcagctactaggtaccgccagaagaagagggctgagcaggaagccctcactggcgagtgtaaagagctagaaaagaagaacgaggctctgaaagagaaggcagattctctcgccaaagagattcagtatctaaaagacctgatagaagaggtccgtaaggcaagggggaagaagagagttccttaatagggtagtcaggtgctttgtgcttgtacatagtcttgtgatgctgtgtttgctgtaataaattattttgtagtgaaagtaaaaaaa

SEQ ID NO: 2198 - DNA, 1780 bp, Rattus norvegicus
  Genbank Accession No. NM_024486
tgtgctgggtgtgccccagagctggctttgactgtacgctgtcaggctctccctggacctcacggaacagcattgccagccacacggcttccaacaaatcacctcttttcatgctgtttggcacagatcgaatctacaggttatacaatggtcgatggagcaatgatcctttctgtgctaatgatgatggctctcccttccccgagtatggaagatgaggagcccaaggtcaacccgaagctttacatgtgtgtgtgtgagggcctctcctgcgggaacgaggaccactgtgagggccagcagtgtttttcctccctgagcgtcaatgatggcttccgcgtctaccagaagggctgctttcaggtctatgagcaggggaagatgacgtgtaagaccccgccgtcgcctggccaggctgtggagtgctgccaaggggactggtgcaacaggaacgtcacggcccggctgcccactaaagggaaatccttccctggatcgcagaacttccacctggaagttggccttatcatcctctccgtggtgtttgcggtatgccttttcgcttgcatccttggcgttgctctcaggaagtttaaaaggcgcaatcaagagcgcctgaaccccagagacgtggagtacggtactatcgaagggctcatcaccaccaacgtcggagatagcactctagcggaattactagatcactcatgtacatcaggaagtggctccggtcttccttttctggtacagagaactgtggctcgacagataaccctgttggagtgtgtcgggaagggccggtatggagaagtgtggaggggcagctggcaaggcgaaaatgttgctgtgaagatcttctcctcccgtgatgagaagtcgtggttcagggagacagaattgtacaacacggttatgctgaggcatgagaatatcttaggtttcattgcttcagacatgacctctagacactccagtacccagctgtggctcattacacattaccacgaaatgggatcgttgtatgactaccttcagctcaccactctggacacggttagctgccttcggatcgtgttgtccatagccagcggccttgcacacttgcacatagagatatttgggacccaggggaagtctgccatcgcccaccgagatctaaagagcaaaaacatcctcgtgaagaagaacggacagtgctgcatagcagatttgggcctggcagtcatgcattcccagagcacgaatcagcttgatgtgggaaacaacccccgtgtggggaccaagcgctacatggcccctgaagtgcttgatgaaaccatccaagtggattgctttgattcttataagagggtcgatatttgggcctttggcctcgttctgtgggaagtggccaggaggatggtgagcaatggtatagtggaagattacaagccaccattctatgatgttgttcccaatgacccaagttttgaagatatgaggaaagttgtctgtgtggatcaacagaggccaaacatacctaacagatggttctcagacccgacattaacttctctggcgaagctgatgaaagaatgctggtaccagaacccatccgccagactcacagctctacgtatcaaaaagactttgaccaaaattgataactccctagacaaattaaaaactgactgttgacattgtcaccggtgtcaagaaggagagtcaatgctgtcattgtccagctgggacctaatgctggcctgactggttgtcagaacagaatccatctgtccccctc

SEQ ID NO: 2199 - DNA, 961 bp, Rattus norvegicus
  Genbank Accession No. NM_024487
acccgggggtagtcatggcggctcggtgcgtgaggctggcgcggcgcagcctcccggctttggcgctgtcgttcaggccttctcctcgcttgttgtgcacagctacaaaacaaaagaacaatggccagaacctggaagaggacttggggcattgtgagccaaagacagatccatcctctgcagacaagaccctcctggaagagaaggtgaagctggaagagcagctgaaggagaccatggaaaaatacaaacgtgctttggcagataccgagaatctacggcagagaagccagaagctggtagaagaggccaagttatatggcatccagggtttctgcaaggacttgctggaggttgcagacatcctagagaaggcaacccagagtgttccaaaggaggaggtcagcaacaacaaccctcacctgaagagtctttatgaagggctcgtgatgactgaagtccagattcagaaggtgttcacaaaacacggcttgctcaggcttgaccccattggggcaaagttcgacccttatgaacatgaggccttgttccacacccctgtggaggggaaagaaccaggcactgtggcactagttagtaaggtgggctacaagctgcatggacgcaccctgaggccagctttggtgggggtggtgaaggacgcttagctctctccctcaaggctctggactttgtaggtcacttgctagaactcaaagggtgggcgggcttgtaatttctcatctgtgaacacatctgacccttgcccagccttgttggaaatcttaagtaagctaagcagaacatgaagctgcttgcacactgtgtcagagactctgggagtctggtcattgagtttagcattacctacttcagaagagggccagcagggcctcaggagtagcatgctaacgttgtatctgttccaccttgtgattaagtactttacacaaataaaagg

SEQ ID NO: 2200 - DNA, 1865 bp, Rattus norvegicus
  Genbank Accession No. NM_024488
cggcacgagctgaattgaggctcaggcacgccggctcaggattggtgctgggccgggccggggtctttggccggaagtggaaaaaggatgcaggaccatcagcacgtgcccatcgacatccagaccagcaagctgctcgattggctggtggacagaagacactgcaacttaaaatggcaaagcctggtgctgaccatccgggaaaagatcaacaccgccatccaggacatgccagagagccaagagattgcccagctgctctctggttcctacatccactacttccactgcctaagaatagtggaccttcttaaaggtaccgaggcttccaccaaaaatatttttggccgctactcttcacagcggatgaaggattggcaggagatcataagcctgtatgagaaggacaacacctatttagtggaactctctagcctcctggttcggaatgtcaactatgagatcccctctctgaagaagcagattgccaagtgccagcaactgcagcaagactacagccgcaaggaggaggagggccaggctggggctgctgagatgcgagagcagttctaccactcctgcaaacagtacggcatcacgggagacaatgtccgacgagagcttctggccctggtgaaggacctgccaagtcagctggctgagataggagcgggagctcagtccctgggggaagccatcgacctgtaccaggcctgtgtggagtttgtatgtgacagccccacagagcaggtgctgcccatgctgcggtacgttcagccgaagggaaactccacggtgtatgagtggaggacagggacagagccctctgtggtagagcggccacaactggaggaccctcccgagcaggtgcaagaagacgagatcgactggggcgactttggcctggaggctgtttctgactctggaaacatcatctctgctgagacccctgggatagactggggtatctccctggagtcagagtccaaggatgctggggctgacaagatagactggggtgacaatgctgttgcttcggagatcaccgtgctggagacaggaacggaggctccagagggtgttgctaggggctcagacgctctgactctccttgaataccctgagactcggaatcagttcatcgatgagctcatggagcttgagatcttcttgtctcagagagcagtagagatgagtgaggaggctgacatcctgtccgtgagccagttccagctggctcctgccatccttcagggccagaccaaggagaagatgctcagcctggtgtccacactgcagcatctgattggccagctcaccagtctggacctgcagcacctgtttatgattctggcctcaccgaggtatgtggaccgggtgacagagctcctccagcagaagctgaagcagtcccagctgttggctctgaagaaggacctgatggtggagaagcagcaggaggcgcttcaggagcaggcagcgctggagcccaagctggacctgctgctggagaagaccagagagctgcagaagctgattgaagctgacatctccaagagatacaacggccgtcctgtgaacctgatggggacctctgtgtgacgtgctggccctgtgtccgccaccagcggcctggtgggggtggacagcccaggctggtattgctggacctcaccagcaagaagccagcagaggtggagcagagccacaaggaagcacctgagtggtggcaccagcattcattgtgacctatgcaagaagtctgagtggctctgtggatctaagcctaaggcacagttgcttcttctggttatcaaggaaggcttaataaaaaaaggaagtgactcctcaaaaaaaaaaaaaaa

SEQ ID NO: 2201 - DNA, 845 bp, Rattus norvegicus
  Genbank Accession No. NM_030586
aggaagttagccgcagaatcccagatagcggccgagagggactcggatccaatggcgaccccagaggccagcggcagcggcaggaatggccagggctccgaccccgccgtcacctactaccggctggaggaggtggcgaagcgaaataccgcggaggagacgtggatggtgatccacgggcgagtctacgatatcacccgcttcctcagcgagcatcctggtggagaagaggttctactggaacaagctggtgccgatgcaactgaaagctttgaagatgtcggccactcccctgatgccagggagatgctaaagcagtactacattggtgatgtccatccgaatgaccttaaacctaaagatggtgacaaggacccttcaaaaaacaattcatgccaaagttcctgggcatattggattgtccccatcgtgggtgctattcttataggtttcctgtatcgtcacttctgggctgacagcaaatcctcctgaggagtccacgttgaagtgtcggagcacatctcctgggagtgagagggtggagacttgtgtggaggaggctgcagggtgctccttccttggatcctgccagttgttttctttccccttggagccaagatggttgaccagatatctatcctccttcaatgcaggaccagaatctgtccatcagcctgagcctgacgcccaaagcacctgctcacgttgtgtccttgtcagggtttcttctcactggttcccagtcattcccttcatttcaacagttgatgccaatgacttagagttcctttgttgtagtgacatttcctttggggacagtacatgatttctgatactttgaattc

SEQ ID NO: 2202 - DNA, 1539 bp, Rattus norvegicus
  Genbank Accession No. NM_030826
gaattccgcgctacaggcatttttgagtccaatatcttctacagtatgtctgctgctcggctctccgcggtggcacagtccaccgtgtatgccttctccgcgcgcccgctggcgggcggggagcccgtgagcctgggctccctgcggggcaaggtgctgctcattgagaatgtcgcgtccctctgaggcaccacgacccgggactacaccgaaatgaatgatctgcagaagcgtctggggcctcgtggcctggtggtgctcggtttcccgtgcaatcagttcggacatcaggagaatggcaagaatgaagagattctgaattccctcaagtatgtccgacccggtggtgggttcgagcccaactttacattgtttgagaagtgcgaggtgaatggtgagaaggctcacccgctctttaccttcctgcggaatgccttgccagcacccagtgacgatcccactgcgctcatgaccgaccccaagtacatcatttggtccccggtgtgccgcaacgacatttcctggaactttgagaagttcctggtaggtccagacggtgttccagtgcgcagatacagcaggcgctttcgcaccatcgacatcgaacccgatatagaagccctgctgtccaagcagcctagcaacccctaaggcattcctggtatctgggcttggtgatggctggctgccctccggggggaggtttttccatgacggtgtttcctctaaatttacatggagaaacacctgatttccagaaaaatcccctcagatgggcgctggtctcgtccattcccgatgcctttacgcctaaagaaaggcggtttcaccactaagaataaagtgctgcggaattccgtgtcttcctgggcacgtttttgtatgaatattcaagaaggcaccccgattactccgtgtccctgctgctgagacttgctaagaaatatgaagccacactggagaagtgctgtgctgaaggcgatcctcctgcctgctacggcacagtgcttgcagaatttcacctcttgtagaagaacctaagaacttggtcaaactaactgtgagctttacgagaagcttggagagtatggattccaaaacgcattctggtccgatacacccagaaagcaccctaggtgtcgaccccaactctcgtggaggcagcaagaaacctgggaagagtgggcaccaagtgttgtacccttcctgaagctcagagactgccctgtgtggaagactatctgtctgccatcctgaaccgtctgtgtgtgctgcatgagaagaccccagtgagcgagaaggctcaccaagtgctgtagtgggtccctggtggaaagacggccatgtttctctgctctgacagttgacgagacatatgtccccaaagagtttaaagctgagaccttcaccttccactctgatatctgcacactcccagacaaggagaagcagataaagaagcaaacggctctcgctgagctggtgaaacacaagcccaaggccacagaagatcagctgaagacggtgatgggtgacttc

SEQ ID NO: 2203 - DNA, 3509 bp, Rattus norvegicus
  Genbank Accession No. NM_030828
cgcccgcctgagtggccggacctcgcgcctcgcgcctcgcgtcccgcgctgcagccgcagtcggcttttgttgtctccgcctcctcgtcggtccccgactctggaccacgagcggcgcgcgctgggaccttggctctgcccttcgcgcagactgggctgagcgggccgggcggccatccagggaggcgcgcacgggcggtcggggagccgcgggccccgccatggagctccgggcccgaggctggtggctgctgtgcgcggccgccgcgctagtcgcctgcacccgcggggaccccgccagcaagagccggagctgcagcgaagtccgccagatctacggggctaagggctttagcctgagcgacgtgccccaggcagagatctcgggagagcacctgcggatctgcccccagggctacacctgctgcaccagtgagatggaggagaacctggccaaccacagccggatggagctggagaccgcactccacgacagcagccgtgccctgcaggctacactggccacccagctgcatggtatcgatgaccacttccagcgcctgctgaatgactcggagcgtacactgcaggatgcttttcccggggcctttggggacctgtacacgcagaacactcgggccttccgggacctgtatgctgagctgcgtctctactaccgaggggccaacctacaccttgaggagacactggccgagttctgggcacggctgctggagcgtctcttcaagcagctgcacccccagctgctgctgcccgatgactatctggactgcctgggcaagcaggcggaggcactgcggccgtttggggatgcccctcgagaactgcgcctgagggccacccgtgcttttgtggcggcacgatcctttgtgcagggcctgggtgtggccagtgacgtagtccgaaaggtggcccaggttcctctggccccagaatgttctcgggctgtcatgaagttggtctactgtgcccattgccggggagtccctggtgcccggccctgtcccgactattgccgaaatgtgctcaaaggctgccttgccaaccaggccgacctggatgccgagtggaggaacctcctggactccatggtgctcatcactgacaagttctggggcccgtcgggtgcggagtatgtcattggcagtgtgcatatgtggctggcggaggccatcaacgccctccaggacaacaaggacacactcacagctaaggtcatccagggctgcggaaaccccaaggtcaatccccatggctctgggcctgaggagaagcgtcgccgtgccaaactggcactgcaggagaagtcctccacaggtactctggaaaagctggtctctgaggccaaggcccagctccgagacattcaggactactggatcagcctcccagggacactgtgtagtgagaagatggccatgagtcctgccagcgatgaccgctgctggaatgggatttccaagggccggtacctacctgaggtgatgggtgatgggctggccaaccagatcaacaaccctgaagtggaggtggacatcaccaagccggatatgaccatccggcagcagatcatgcagctcaagatcatgaccaaccgtttacgtggcgcctacggtggaaatgatgtggacttccaggatgccagtgatgacggtagtggttccggcagcggtggcggatgcccagatgacgcctgtggtcggagggtcagcaagaagagctccagctcccggacccccttgatccatgccctccccggcttgtcagaacaggagggacagaagacctcggccgccactcgcccagagcctcactacttctttctgctcttcctgttcaccttggtccttgctgcagccaggcccaggtggcggtaactgccccctagcccaaaggactgtcttggccaaaacatgcaacagaccatatttacttcccttggccttcgaggcccagggcaggataaggagacagtagctctgagtgctggggcagggcgcatggggtcctggccttcctgggtctggccacgcctgtcaccctagcttctagttgttgtatcaggtcagctgcgagccagtgtccccaaaagccatgtttttcagggacctcaggggcacctctggctgcacactcctcccctaccctcctgtaccaccccagaagctcacgaggtcacccagaagggcggttattagctacaacccatcggagacctcaagtgagtctgtgtcttcctctcctgcctcttcccggtggggactccccaccagaccccatgggacacagatgtcagaaattgaggcccatcccgcagctccccaggaagcctggaagggatgccagtatgtcgctgaccaggctctggcagggcctacaagtttatgcatgataccttctcctcagaagaagctctgcaggcaggatcccaacacacaccagaccaggaccctgtgccactgtggagctcagtgaatctggttctcaaagaagacccactgtggggttcctctagtgtgacataggtgaggtggcagctggcaaggccgcactaggctgccacactgtttgccccctcagatgggctcataaagactgggcttgagggtccacatgaagagcctcacttcaggggaatagccggccacgtctagcccctatcccacttagaaaggtcacctggccacggtgatgctgggtggctgatgaaacttaagctcagggtcagtgggacctggcactgcaggtcaagaggacgcctgggccccttcctgacccaggcagctctgcaggagctgggggagcattgacagtcaagggcttttatagacatacacattcagaccctcggtgtccttgtccactgagtgctgtatctcatcgtatctcaatcttcattgacagcactggagaggctcggggcaccacttggagccttgtatcccgcaggcttgagacctgggggcacctggcttaccaaggttggcaaggctccatcttcccttccaggggcttggggatgctaagttgctgtatccaggaagacagtagtcctcacatgcagaaggcctgggaaaaggctgcttgtcgctttttttttttcctttctttttgtcactgggttagagaggctcccgccagcacagcaccaaggcctgcccagtagtcaggtctcctggtccaggatgggtgtgctctgtagttggtctgtgggtttcttaggcccatgccctgagcacattcacccagccacatccctgctagtgacactcaggcaggggcactgggaaccagacctgggctctggcatcaacgagtgcctaggtgtcaggacagcggcacccatcctgtacagggcagccaggatagtggccaagctactgtgtcctttctccatgaggctccctgtcactcggtgccagtgggtaatgtgtgttctttgagtccttatatgaataaaaggctggagacctaccaaaaaaaaaaaa

SEQ ID NO: 2204 - DNA, 2099 bp, Rattus norvegicus
  Genbank Accession No. NM_030846
aagctaggctgctctgctgcttctgcgatcgggcggcggcggggcgagccaagctgcggcgggggacggcggtctgggcagcgggcgccgcagtcagggagcagcagtgaggttggcggccgcgggcggcacacaaggcgggccaggccgggtgagggagcggacggcacgtcgcgggtggcattgtgtgtcccagtgtgcaagaatagccccagaagaggaaaggctgagcccagagcgcttcagcagggaagattcccttccccccgcttcaggctgctgagcactgagcggcgctcagaatggaagccatcgccaaatatgacttcaaagctactgctgacgatgagctgagcttcaagaggggggacatccttaaggttttgaatgaagagtgtgatcagaactggtataaggcagaactcaatgggaaagatggcttcatccccaagaattacatagaaatgaaaccacatccgtggttttttggcaaaatccccagagcaaaggcagaagaaatgcttagcaaacagcggcatgacggggccttcctgatccgagagagcgagagcgctcctggggatttctccctgtcagtcaagtttggaaatgatgtacagcacttcaaggtgcttcgtgacggagccgggaagtacttcctgtgggtggtgaagtttaattctttgaatgagctggtagattaccacagatcaacatccgtgtccaggaaccagcagatattcctccgggacatagaacaggtgccacaggaggatggtgagctgggctttcgccgaggagacttcattcatgtcatggataactcagatcccaattggtggaaaggggcctgccatgggcagaccggcatgtttccccgcaattatgtcaccccagtgaaccggaacgtctaagaagcaaaagagattatttaaagaaagtgaaaagttgagaccgttcacaagaattacacccacacgctgcctgtcacagcctgtgagggaacgcagaacacctggctgggtcccacgggcgaccctctcacttaagttgcaacttttgggggtgggaaggggtgtttgatttcataatgccaaaacttaacctattgaatgaattacagtttttattacggaatctcgccgctactcgtgttcccttcctgtgtccttttttcgcgttctttctttcctgtccagtgcatgatgtttaaggccacatatagtccagctgatgccaataataaaagaaaagaaaccaagtgggctggtattttctctatgcaaatgtctgtggagatggatggactagaggagccggattcttcacacacaggggcagccattgtatcggggcccttggttgggattcactggagatgcctaagggcatctgcctccggcctgaagcctggagcattccatcagagttggaattagggcaggagcctgctgcccacccatggtctcctgagagccagactgcagagctgccctccccactgcctcccttcagtgtctcacttgttttcatagtgcctttgtcttatttcaagggtgttcatgagtggtgtctttaccttttttatttttttaaataagttaaagatagtccagagcttttcagttgattagtctcctatcctatgtacatattttcctctcagggcaggagaaagaggacagagaaaggagctggcagaagcagagagggtgtatttcccatcttaaatgggccagaggtcttgaaggatcagcttttacattgtgagctttgacacctgcttcagctcagactcaccggccctcagagtccctgccctccaggtcccagttgccctttctatgcctagagccactaagggtcaaaacacaaggcaggcaggggggagcgggtggcatccttccctctcataggcctacaagcaggtggaagttgaaaattctggcctttaatttttcttgctcttacaattaagtcctcgttctcagttgcacatttccccccacctgtccacgagtacgaatggcaggattcgggggctggttcgatggttgcatctctgtgcacaacagtggtgtttcgacgtcgtctccgtc

SEQ ID NO: 2205 - DNA, 737 bp, Rattus norvegicus
  Genbank Accession No. NM_030847
cgaggacagactccaactctgacttcttcagcgactctcgagacttcccgaaccaagccgtctttcctcagaccttacagtcctcccagccttcctctctgacttagagagccagaccccagccctcttcccccaggattgagtgctccgacccttcgaaggcttgcctctcctgctctgagccagcatctggcagccatgtcactcctcctgttggtggtctctgcccttcacatcctcattcttgtcttgcttttcgtggccactctggacaagtcctggtggactctcccagagaaggagtccctgaacctgtggtatgactgcacgtggaacaccaccgctaaaacgtgggcctgcagtaacgtcagtgagaacggctggctgaaggcagtgcaggcgctcatggtgctgtctctcatcctctgctgtctgtccttcatcctcttcatgatccaactctacaccatgcggagaggagggctcttctacgccaccggcctctgccagctctgcaccagtgcggctgtgttctccggggcactgatctatgccatccatgctaaggagatcctggcaaagcacccgagtggaggcagcttcggctactgcttcgccctggcctgggtggcctttccactcgccctggtcagtggcatcatctacatccacctgcggaaacgagaatgagcgctgtgtccccctagaaaataaagccctgtaaccacaaaaaaaaa

SEQ ID NO: 2206 - DNA, 1557 bp, Rattus norvegicus
  Genbank Accession No. NM_030860
ctctctggcactaaggacccctggagaagatggggaggaaaaagattcagatccagcgaatcactgatgaacggaaccgccaggtgacattcaccaagcggaagtttgggctgatgaagaaggcctacgaactgagtgtgctgtgcgactgtgagatcgcgctcatcatcttcaaccactccaacaagctgtttcagtacgccagcaccgacatggacaaggtgctgctcaagtacacggagtacaacgagccgcatgagagccgcaccaatgctgacatcattgagaccctgaggaagaagggtttcaacggctgtgacagcccagagccggatggggaggactcactggagcagagccccctgctggaggacaagtaccggcgggccagtgaggaactggatgggctcttcaggcgctatgggtcatctgttccggcccccaattttgccatgcctgtcacagtgcccgtgtccaatcagagctccatgcagttcagcaatccaagtagctctctggtcactccttccctggtgacatcatcccttacggacccacggctcctgtccccccagcagccagcactacagagaaacagtgtttctccgggcctgccccagcggcctgctagtgcaggagccatgctgggtagagacctcaacagtgctaatggagcctgccccaaccccgttgggaatggctacgtcagtgcccgggcttcccccggcctcctccctgtggccaatggcaacggcctaaacaaggtcatccctgccaagtctccacccccacccacccacaacacccagcttggagcccccagccgcaagcctgatctgcgggtcatcacttcccagggaggcaaagggttaatgcatcatttgaacaatgcccagcgccttggggtctcccagtctacccactcgctcaccaccccagtggtttccgtggcaacaccaagtttactcagccagggcctccccttctcctccatgcccactgcctacaacacagattaccagctgcccagtgcagagctttcctccttaccagccttcagctcacctgcagggctggcactaggcaacgtcaccgcctggcagcagccccagcagccccagcagccacaaccaccacaaccgccacagtcacagccacagccaccacagccacagccacagcagccacctcagcaacagccccacttggtccctgtttctctcagcaacctcatccctggcagccccttgccccatgtgggtgctgctctcactgtcactacccacccccacatcagcatcaagtcagaaccagtgtccccaagtcgtgaacgcagccctgcacctcctccaccagctgtgttcccagctgcccgccctgagcctggcgaaggtctcagcagcccagctggaggatcctatgagaccggggaccgggatgatggacggggggactttgggcccacactaggcctgctgcgcccagccccagagcctgaggctgagggctcagctgtgaagaggatgcggctggatacttggacattaaagtgatggt

SEQ ID NO: 2207 - DNA, 2099 bp, Rattus norvegicus
  Genbank Accession No. NM_030863
gcacccggttctcccgagtccttgccgaagtgtactgcgcgctcagagcagcccgacagtttccagccaaacttcagcaactcctcccttgccgcaccatgccgaagacgatcagtgttcgtgtaaccaccatggatgcagagctggagtttgccattcagcccaacaccactggcaagcagctgtttgaccaggtggtgaaaactattggtttgagagaagtttggttctttggtctgcagtaccaggacacaaaagctttctctacttggctgaaactcaataagaaggtgactgcacaggatgtccggaaggaaagtccgttgctcttcaagttccgggccaagttctatccagaggatgtgtctgaagaactgattcaggatatcacccagcgcctgttctttctgcaagtgaaggagggcattctcaatgatgacatttattgtccacctgaaaccgctgtgctcttggcgtcctatgccgtccagtctaagtatggtgacttcaacaaggaagtgcacaagtctggctacctggctggagataagttgcttccccaaagagtcttggagcagcacaaactcaacaaggaccagtgggaagagcggatccaggtatggcatgaggaacaccggggcatgctcagggaggatgctgtcctggaatatctcaagattgctcaggacctggagatgtatggtgtgaactatttcagcatcaagaacaagaaaggctcagagctgtggctgggtgtggatgccttgggtctcaacatctatgagcagaatgacagattgactcctaagattggcttcccttggagtgaaatcaggaacatctctttcaatgataagaaatttgtcatcaagcctattgacaaaaaggccccggactttgtgttctatgctcctcggcttcggattaacaaaaggatcttggccctgtgcatggggaatcatgagctgtacatgcgtcggcgaaagcctgacaccattgaggtgcagcagatgaaggcccaggctcgagaagagaagcaccagaagcagatggagcgtgctctactggaaaatgagaagaagaagcgtgagctggctgaaaaagagaaggagaagattgaacgggagaaggaagagctgatggagaagctgaagcagattgaggagcagaccaagaaggctcagcaagaactggaagaacagacccgcagggccctagaacttgagcaggaacggaagcgtgcccagagtgaggctgaaaagctggccaaggagcgtcaagaagctgaagaagccaaggaggccctgctgcaggcttctcgggaccagaagaagactcaggaacagctggcttcagaaatggcagagctgacagcacgggtctcccagttggaaatggctcgaaagaagaaggagagtgaggctgaggaatgccaccaaaaggcccagatggtccaggaagacttggagaagactcgcgctgagctgaagacagccatgagtacccctcatgtggcagagcctgctgagaatgaacatgatgagcaggatgagaatggagccgaggccagtgctgagctgcgggctgatgctatggccaaggaccgcagtgaggaagaacgtaccactgaggcagagaagaatgagcgtgtgcagaagcatcttaaggcccttacttcagagctggccaatgcccgagatgagtccaagaagactaccaatgacatgatccatgctgagaacatgcgactgggacgagacaaatacaagaccctgcgccagatccggcagggcaataccaaacagcgcattgatgaatttgagtccatgtagtgggcgcgcagccgttagggacccctcctccttcttccttgtcccccacactcctatagttttgcctaactaacaccctgctggagccactaactagaaaagccttggagccataccaaacattcagtatgaccatgggaccaaatttagtttccctattcatatccttgggcaaacaaatggcccacctgtgtagccaatggaacctcctcttccttctttgtcacactcattcaacatagctctctagaatagaccatttccccc

SEQ ID NO: 2208 - DNA, 2207 bp, Rattus norvegicus
  Genbank Accession No. NM_030872
gtctcccggctgtgcttggccgtgcggagggccggtgccagcacctccagctccgggacagcagcgggagccaagcccgagccgcaggcgtcgtcgccatgcgctggttccgggcgctgttgaagaatgcgtccctggcaggggcgcccaagtacatcgagcacttcagcaagttctccccgtccccgctgtccatgaagcagtttctagacttcggatccagcaatgcctgcgagaaaacttcattcaccttcctccggcaggagctgcccgtgcgcctggccaacatcatgaaagagatcaacctgcttcctgaccgggtgctgagcaccccctcagtgcaactggtgcagagctggtatgtccagagtctgctggacatcatggaattcctggacaaggaccccgaggaccaccggaccctaagccagttcactgatgccctggtcaccatccggaaccggcacaatgacgtagtgcccaccatggcacagggagtgttggagtacaaggacacctatggtgatgacccagtctccaaccagaacatccagtactttttggaccgcttctacctcagccgcatctctatccgcatgctcattaaccagcacaccctcatctttgatggcagcaccaacccagcccaccccaaacacattggcagcattgatcccaactgcagcgtgtctgatgtggtgaaagatgcctatgacatggctaagctcctgtgtgacaagtattacatggcttcccctgacctggagatccaggaagtcaatgccaccaacgccacccagcccattcacatggtctacgtcccctcccacctctaccacatgctctttgaactcttcaagaatgccatgcgggccacagtggaaagccacgagtccagcctcactctccctcccatcaaaatcatggtggccctcggtgaagaagatctgtccatcaaaatgagtgaccgaggcgggggtgtccccttgaggaagatcgagaggctcttcagctacatgtactctacagctcctacaccccagcctggcactgggggtaccccgctggctggctttgggtatggactccccatttcccgcctctacgccaagtacttccagggggacttgcagctcttctctatggagggctttgggacagatgctgtcatctatctgaaggccctgtccacggactcagtggagcgcctgcctgtctacaacaagtctgcctggcgccactaccagaccatccaggaggccggtgactggtgcgtgcccagcacagagcccaagaacacatcgacgtatcgggtcagctaggggccttctcttcctggcacctgggaggatgctgccacctctgaatccagccaccacagggacttccctatctatcccctggggtacgggggtgaaactgggtctccccgatggccagatctgtctttgtagaaatcgcagtggcccatctgtggcgatccctaagtgccaatctgtctctatggagaaacctagggggtttccctggagcctggtctccatggtgatgatgcttgagggttggggacggctctacctggtggggtggccccagagacacttctcccaagaccagagctgtctgttttctaccagaaaccctgggtccccctcactgcctgcatagtcctggtctcccacgtggctgcctcgcttgccttatgcccacaccctgtacaggcacattgggctggtttcttcgtcagtagtaagaaagatggagagagactggggaaacgggggccaaccttgtctctggtcctgcagcctctctccatctccactctggacactaaagttgccactgggaacttgagaatgggtggccgttctcacccaaggcccaccgagaaggcctaagagtaacctgtccccaaggcgatcttagcaatgtttctgccgcttcctggcctggcatgtcctcacgtgtatacctcccctgcccagtgtacgctcaccctatccctgcttgagctttagaccccagacttcctatgcccactatgtgtgcacagacgactcaaacccaggatgccccatgtacatagccagttttgtaatctcagatgcctcacccttgccctccgcacacaggggttaaagccgtgtgcccctcccagtggctgggatggtgacagtgacatccacagtaaatagatgaaatga

SEQ ID NO: 2209 - DNA, 2837 bp, Rattus norvegicus
  Genbank Accession No. NM_030987
gaattcggcacgaggtggaaagcactgagacgtgaagatgagtgaacttgaccagctgcggcaggaggccgagcaactgaagaaccaaattagagatgcccgtaaagcatgtgcagatgcgactctttctcagatcacaaacaacattgatccagtgggaagaatccaaatgcgaaccaggagaacactgagggggcatctggcaaagatttatgccatgcactggggcacagactcaaggctccttgtcagcgcctctcaggatgggaaactcatcatctgggacagctataccacaaacaaggttcatgccatccctctgcgctcctcttgggtcatgacctgtgcatacgctccttctgggaattatgtggcctgtggtggcctggataacatctgctccatttacaatctgaaaactcgtgaaggaaatgtgcgtgtgagtcgtgagctggcaggacatacaggttatctatcctgttgccggttcctggatgacaatcagatagttaccagttctggagacaccacatgtgccctgtgggacatcgagaccggccagcagacaaccacgtttactggacacactggagatgtcatgagcctgtctcttgctcctgacaccagactgtttgtctctggtgcttgcgatgcttcggtcaagctctgggatgtccgagaagggatgtgccggcagacctttacaggacacgagtctgacatcaatgccatatgtttctttcccaatggcaatgcctttgccactggctcagacgatgctacatgcaggctgtttgaccttcgtgcagaccaggagctcatgacctactcccatgacaacattatctgtggtatcacatctgttcccttctccaagagtggccgcctcctcctcggtggctatgacgacttcaactgtaatgtctgggatgcactcaatgctgacagagcaggtgtcctagctggacatgacaaccgagtcagctgcttgggggtgactgatgatggcatggctgtggcaacaggatcctgggacagcttcctcaagatctggaactaaggccacagcaggtggatggatgccatggcgactggaagaccattccaaccttgaagcgttactgcgatagcatatcctatccaaccatactaacgtggacacccacacctcccctcagaacttcaaaagggcaagatcttttttccttcacttattgctgaaaccaagagcacaactcccattaagagaaggatctctgtgctgtaaactaaaacaaattgtgcatttttctggggccattgtctttggtttattttgttttgttttttgtttttgttttgtttgtcttgggcaaatttttaaaggaaatactacaataaaaatgttaaccagaaggtaaccctgagtatgattgtgagagagacacaccttcttactagttcatttgcatttaaatcagtgatcctgatctgtggcaatcatgaaaaacaagttgaagactttgtttatctggaattgtttctaaatataagtcatttgtagcaagactttggaagcattcacgtttcttccttaaacatattcctttatgttcagtagttaagagaaccagagcccatgggggtgtctgactgtcactgatgcatttttgtccctggcttgcttttttttttttttttttttttttgtctcatgtcacagatgactgtttcgcacaaacacagcatagtggaagaaaaaattcagaagcaaagtagccaagcacatgttatgatggccacgaatgcttggtcagaatccttccctttgctcagcagtgaacttattcccagcacccttccctcctcactgtccagtttctgttctttccttgggtttcctgtgaagttggagggaagtttgtagtcatgtgacactagccgtcctgcccctgctgtcagattttttttctccagagaggtgcctgtcctgtgcttggatagtcagtttgtgtatgaaacaatgtacaaatcaatgttttgaaaataatgatctcagactttctaagttaaattttaaacaatttgattgtttgccatattgggtgggtttactcttagaatcgcatgctgtagaaatgctctaaagtgcatataggactcagtccttagatgttctttttattttaagaaataacctcttcaagttgtaaccgtggcggctttgtccattactgttgctattctgcacacatatcggaagcagcaagcgctttacacactcgagtagtgggataagtcactgttttctttactttacaagatgatagtcctgttgggaatgactgctgctggcttcaggaagggagggaagctgctccgctgcctctttgccacttcctggaagcagcctccatggaacagcctttgcatctgaggcaaccatttttacaccgtgcagatcttcgtggttatcatctcaaagccatgttcagcagcagcgtttggacagcagtgttctgtgggccctcccatcccccgatatcctgcacccctcatagcagtagtggcttcgccattctgttttctgcagcgtcctgtacaaaactgtgctgtgactgtgcggtaggcctggacatggcaaagagaatacagcgaagccccttctcttcctaccaaacgactctgtagagctctctgcaccctgtaccctttccaccttttgtatttaattttaaagtcagtgtactgcaaggaggctggatgcaagatagatactatattaaactgtactgttatttaagatgtaataaagcagtttgacatgaggaaaaaaaaaaaaaaaaaaaaaaaaaaaa

SEQ ID NO: 2210 - DNA, 2100 bp, Rattus norvegicus
  Genbank Accession No. NM_030991
aattcggcacgagcagagctcacgttgcattgaagacgaaacctcggggaggtctggagctgtctttccttccctccctacccggcggctcctccactcttgctacctgcagggatcagcggacagcatcctctgaagaagacaaggttccttaactaagcaccactgacttgctggccccggcgcccagcaaccccccaccactaccatggccgaggacgcagacatgcgtaatgaactggaggagatgcagaggagggctgaccagctggctgatgagtccctggaaagcacccgtcgcatgctgcagctggtcgaagagagtaaagatgctggcatcaggactttggttatgttggatgagcaaggcgaacaactggaacgcattgaggaagggatggaccaaatcaataaggatatgaaagaagcagaaaagaatttgacggacctaggaaaattctgcgggctttgtgtgtgtccctgtaacaagcttaaatccagtgatgcttacaaaaaagcctggggcaataatcaggatggagtagtggccagccagcctgcccgtgtggtggatgaacgggagcagatggccatcagtggtggcttcatccgcagggtaacaaacgatgcccgggaaaatgaaatggatgaaaacctagagcaggtgagcggcatcatcggaaacctccgtcatatggccctagacatgggcaatgagattgacacccagaatcgccagattgacaggatcatggagaaggctgactccaacaaaaccagaattgatgaagccaaccaacgtgcaacaaagatgctgggaagtggttaaatctgcccttctgctgtgctctcctccaatgttgttggacaagagagaagagagctccttcatgcttctctcatggtattacctagtaagacttacacacacacacacacacacacacacacacacacacacacacacacacacacacacagagtcagtcacccccattgtaaatgtcctgtgtggtttgtcagcttcccaatgataccatgtgtcttttgttttctccggctctctttctttccaaaggttgtacatagtggtcatctggtgactctatttcctgacttaagatcttgggtctctctcttttttcctttttcttttctcagtggcgtttgctgaatgacaacaatttaggaatgctcaatgtactgttgatttttctcaatacacagtattgttcttgtaaaactgtgacattccacagagctactaccacagtcctttcttagggtgtcaggctctgaatctctccaaatgtgctgtctttggttcctcatggctattctttgtctttatgatttcataattagacaatgtgaaattacataacaggcattgcactaaaagtgatgtgatttatgcatttatgcatgagaactaaatagacttttagattcctacttaaacaaaaactttccatgacagtagcatactgacaagaaaacacacacaacagcaacaataacaaagcaacaactacgcatgctcagtattgggacactgtcaagattaagtcataccagcaaaacctgcagctgtgtcaccttcttctgtcaacatacagactgatcataatcatcccttctttacacacacacacacacacacacacacacacacacacacaaatggatttaacacaccattaatcatttctagcaaaatatatgtttggctgaaactatgtgaaatgggtgtaatatagggtttgtcgaatgcttttgaaagctctgttttggagacaatactcttgtggaaaacgtgaagatcttctaagtctggctcttgttgatcaccatctccctgtggtttgtcatcagtacaactctttgttgcttaatctagagctatgcacaaccaaattgctgagatgtttagatgctgataaagaaacctttaaaaaattatataaatgaatgaaatatagataaactgtgagataaatatcattacagcatgtatattaaatccctcctgtctcctctgttggtttgtgaagtgatttgacattttgtagctagtttaaaattattaaaaattataga

SEQ ID NO: 2211 - DNA, 10120 bp, Rattus norvegicus
  Genbank Accession No. NM_030995
agactcttccctgaagctgccgggctaaggctaaggccagagccaatgcctccatgaggggctccctcccacaccccggggccagaggaccctctgccaccagagtgagatcctcgagaccatcatcctagtcaaccccagtgcagacagtatcagctcagaggttcaccatcttctcagcagcccatcagctcacaaactcctgatcctgagtggacaaactttagaacctgagggagaccttatcctacagagtggtacctactcatatcaaaactttgcccaggtccttcacaaacctgagattgcccagttgcttagcaacagagacccggagatccaggccttcctcactgtttcctgcttaggggagggtgactggagccacctgggactgtccagttcccaagagaccttgcacctccggctaaatcctgagcctgtgctacccaccatggatggtgtggctgagttctccgagtatgtctctgagactgtggatgtgccatccccctttgacctgcttgaaccgcccacctcaggaggcttcctcaagctctctaagccttgctgctacatctttcctggtggccgtggggactctgctctctttgctgtcaatggctttaacatcctggtggatggcggttcggatcgcaagtcctgcttctggaagctggtgcggcacctggaccgcatcgactccgtgctgctcacacacattggggctgacaatctgccgggcatcaacggcctcctgcagcgcaaggtggcagagctagaggaggagcagtcccagggctccagcagctacagcgactgggtgaagaacctcatctcccctgagcttggagttgtgttcttcaacgtgcctgataagctccggctgcccgacgcctcccgcaaggccaagcgcagcattgaagaggcctgtctcactcttcagcacttaaaccgcctaggcatccaagccgagcctctgtatcgtgtagtcagcaacaccatcgagccactgaccctcttccacaaaatgggtgtgggtaggctggacatgtatgtcctcaaccccgtcaaggacagtaaggagatgcagttcctcatgcagaagtgggcaggcaatagtaaagccaagacaggcattgtactggccaatgggaaggaggcagagatctctgtcccctacctgacctccatcactgctctggtggtatggctcccagccaaccctactgagaagattgtgcgtgttcttttcccgggaaatgctccccagaacaagatcttggagggcttggaaaagcttcggcacctggactttctgcgctaccctgtggcaacgcagaaggacctggctgctggggccgtgcccgccaacttgaaacccagcaaaatcaaacatcgggctgacagcaaggagagcctcaaagctgctcccaagacagcagtgagcaagctggccaaacgggaggaagtgttggaagagggggccaaggaggcccgctcagagctggccaaggagttagccaagacagaaaagaaagcaaaagaaccgtctgagaagcccccagaaaaaccctccaagtccgaaagggtgaggggcgagtccagcgaagcgctgaaggccgagaaacggaggctgatcaaggacaaggccggcaagaagcacctgaaggaaaagatttcaaagctagaggagaagaaggacaaggagaaaaaggagatcaagaaggaaaggaaggagctcaagaaggaggaagggagaaaggaagagaaaaaggatgccaaaaaggacgaaaagaggaaagataccaaaccagaggtcaagaaactctccaagccagacctgaagccttttacccctgaggtccgtaagaccctctacaaagccaaggcccctggcagggtcaaggtggacaaaggccgagccgcccgtggagaaaaggagttgtcttctgagccccggacacccccagcccagaagggggctgctccgcctgcagctgtcagtgggcacagagagttggccttgtcctcaccagaggacctcacacaggactttgaggagttgaagcgtgaggagagaggtttgctggctgaacaaagagatacggggctgggtgagaaaccactccctgcagatgccacagagcaggggcacccgagcgcagccatccaggtgactcaaccctctggccctgtgctggagggagaacatgtggaaagggagaaagaggtagtcccagactccccaggggataaagggagcacaaacagaggcccagactctggggctgaggtcgagaaagagaaagaaacctgggaggaaaggaagcagagagaagcagagctgggcccagagaacactgcggccagggaggagagcgaagctgaggtaaaggaggatgtgatcgaaaaggccgagttagaggaaatggaggagactcatccttcagatgaggagggggaagagacaaaggctgagagcttttatcagaaacatacgcaggaagccctaaaggctagcccaaagagcagagaggctcttggcggccgggacctggggttccagggcaaggcacccgagaaggagacagcatcattcctaagcagtttggccacacctgcgggagccactgaacacgtctcttacattcaggatgagacaatccctggctactcagagactgagcagactatttcagatgaggagatccatgatgagccagatgaacgcccagcgccgcccagatttcctacgagtacctatgacctctctgggcctgaaggtcctggcccctttgaagccagccaggctgcagatagtgctgttccagcctcctcgagcaaaacttatggggcacctgagactgaactcacctaccctcccaacatggtcgccgcccctctggctgaagaggaacatgtgtcctcagccacgtcaatcaccgagtgtgacaaactctcttcctttgccacatcggtggctgaggaccaatctgtggcttcactcacagctccccagacggaggagacaggcaagagctccctgttgctcgacactgtcacgagtatcccctcttcccgcactgaagccacccagggcctggactatgtgccgtcagctggtaccatctcccccacctcttccctggaagaagacaagggcttcaagtcaccaccctgtgaggatttctctgtgaccggggagtcggagaagaaaggagagactgtggggagaggcttgagcggggagaaggctgtggggaaggaggaaaaatatgtagtgacgtctgagaaactgtccggtcagtatgctgctgtgtttggtgcccctggacacaccctacccccgggggaaccagccctcggagaagtggaggaacggtgcctcagcccagatgacagcacggtgaagatggcttctcctccaccatctggcccacccagtgctgcccacacgccctttcaccagtctccagtggaagacaagtctgagccgcgagactttcaggaagattcctggggagaaacaaagcattctccaggtgtgagcaaggaagactctgaagagcagacggtgaagccagggcccgaggagggcacttcagaagaggggaagggacctcctaccaggagcccccaagcccaggacatgcctgtgagcattgctgggggtcagactggctgtactatccaactcttaccagaacaagacaaagccatagtgtttgagactggagaggcaggttcgaatctcggagcagggaccctccctggagaagtgaggacatcaactgaagaagccactgaacctcagaaagatgaggtacttcgctttactgatcaaagcctttcccctgaagatgcagagtctctgtctgtcctcagtgtggtctccccagacactaccaaacaagaggccactcccaggtctccctgcagcctgaaagagcagcagccgcacaaagacctttggccaatggtgtctccagaagacacccagtcactttctttctcagaagagagtcctagcaaggagacctctctggatatctcttctaagcagctctctccagaaagccttggcaccctccagtttggagaactgaacctaggaaaggaagaaagggggcctgtgatgaaggcagaagacgactcttgccacctagctcctgtgtctattccagagccacacagggccacagtgtcacctagcacagatgagacccctgctgggactttacctggtggctctttttctcactctgcactgtcagtcgataggaagcactcacctggggagatcacgggccctggtggacactttatgacatctgatagctccctcaccaagagtcccgagtctttgtcaagtcccgccatggaagatctggccgtggagtgggaaggtaaagctccagggaaggagaaagaacctgagctaaagagtgaaacccgacagcaaaagggccagattctgccggagaaggttgctgttgtggagcaggacttgatcatacatcagaaagacggggctctggatgaggagaacaaacctggaaggcagcaggataagactccagaacagaaaggcagagacttggacgaaaaggacacggctgcagagctggacaaaggcccagaacccaaagaaaaagacttagaccgggaggaccagggccagagagcagggcctccagcagagaaggacaaggcctcagaacaaagggacacagacctgcaacagacccaggccacagaaccaagagacagagcacaagagcgcagagattcagaagaaaaggacaagagtttagagctgagagataggactcctgaagagaaagatagaatattagtacaggaagacagggctccagagcacagcatccctgaaccaacacagacagacagagctccagatcgcaaaggcacggatgataaagaacagaaggaggaggcctcagaagagaaagaacaggttttagaacaaaaagactgggccctaggaaaggagggtgagaccttggaccaagaggccagaactgctgaacagaaagatgagaccctaaaagaggacaaaactcagggacagaagagctctttcgtcgaagataaaaccacaacatcaaaagagacggtccttgaccaaaagtctgcagagaaggccgacagtgtggagcagcaggatggagccgccctggagaagaccagagctttggggctggaagagagcccagcagagggaagcaaggctcgagagcaggaaaagaaatactggaaggaacaggatgtggtccagggatggcgagaaacatctccaaccaggggagagccagtgggaggccagaaagagcctgttccagcctgggagggcaagtctcctgagcaagaagtccggtattggagggacagagacataacactacagcaggatgcatactggagggagctaagctgtgacaggaaggtctggttcccccatgagctagatggccaaggagcccgtccacggtactgtgaggaacgtgaaagcacttttcttgatgaggggccagatgaacaagaaataacccccctgcagcacactccccggagtccctggacctcggatttcaaggatttccaggagcccctgccacagaaggggctggaagtagagcgctggcttgctgagtcaccagttggcctgccaccagaggaagaggacaaactgacacgctcgccctttgagatcatctcccctccagcatccccacctgagatgactggacagagggttccttcagctccaggacaagagagccctgtcccagacactgagtccacagcacccatgaggaatgaacctaccaccccttcatggctagctgagatcccaccttgggtacctaaggacaggcctctgcctcctgcacccctctccccagctccagctcccccaacacctgccccagagccacatactcctgtgcccttctcctggggcttagctgaatatgacagtgtggtggctgccgtgcaggagggggcagcggagctggaaggcggcccatactccccactcgggaaggactatcgaaaagctgaaggggaaagggaaggagagggtggggctggagctcctgacagcagctccttcagtccaaaggtcccagaggctggtgagagccttgccaccagggacactgagcagactgagccagagcagagagagcccacaccctatcccgatgagagaagctttcagtatgcagacatctatgaacagatgatgcttactggactgggccctgcttgccccaccagggagcctccactgggggcatccggggactggcccccacacctctcaaccaaggaggaggctgctggctgcaatacttctgcagagaaggagacttcctcccctgcctcgccccaaaacctccaatctgacactccagctttcagctacgcatctctggcaggacccgctgtacctcccaggcaagaaccggatccaggacccaatgtggagcccagcatcacccctcccgcagtgccccctcgcgcccctatctccctgagcaaagacctgagtccccctcttaatggaagcactgtgagctgcagcccggacaggaggaccccatccccaaaggaaacgggccgaggtcactgggatgatggtaccaatgactcagacctggagaagggggcccgggaacagcccgagaaagagactcggtccccaagtccccatcaccccatgcctatgggccactcctcactgtggcctgaaaccgaggcatacagcagcctttcctcagactcacacctaggatctgtccgtccaagtctggacttccctgcttcagcctttggcttctcctccttgcagcctgctccccctcagctgccctctccagctgaaccccgctccgcaccctgtggctcacttgccttctctggggaccgagctctggccttggttccaggaactccaaccagaacccgacatgatgagtacctggaagtgaccaaggcacccagcctggattcctcactgccccaactcccatcacccagctctcctgggggccctcttctctctaacctgcccagacctgcctcgccagccttgtctgaagggtcctcttctgaggctaccacgcctgtgatttcaagtgtggccgaacgcttccctccaggtctcgaggcagctgaacagagtgctgaaggactgggctcaggaaaagagtcggctgcccacagcctctgggacctcactcccctgagcccagctccctcagcttcactggacttggctccagctccagctccagctccagctccagctccaggcctgcctggagacttgggcgatggtaccctgccctgccgccctgagtgcacaggggaactcaccaagaagccaagccccttcctgagcccctctggagatcatgaagccaatggcccaggagaaaccagccttaatcccccagggtttgtcacagccacggcagaaaaagaagaggctgaagcccctcatgcttgggaacgagggtcctggcctgagggagctgagaggagctcccggccggatacacttctctcatctgagcagccactgcgtcctgggaagagctccgggggcccaccctgcagtctttcttctgaagtcgaggctggacctcagggatgtgctacggatccccgcccccactgcggggagctttccccctcattcctgaaccctcctctgcctccatccacagatgacagtgacctttccacggaagaagctcggctggcaggaaaaggagggaggcgacgggtagggaggccaggggccacgggaggtccatgccctatggctgatgagacaccccccacatcagccagcgactcaggctcctcacagtcagattctgatgtcccaccagaaactgaggagtgtccatccatcacagctgaggcagccctcgactcagatgaagatggggacttcttgcctgtggacaaagctgggggagttagcggaactcaccatcccagacctggccatgacccacccccaacccccctaccagacccccgcccatcccctccacgaccggatgtttgcatggctgaccctgaggggctcagctcagagtcggggagggttgagagactacgagaaaagggacgacctggccgtagggcccctggccgggccaagcctgcatctcctgctaggcggttggatattcggggaaaacggtcacctactcctggcaaagggcctgtagatcgaacatctcgtactgtaccccgaccacggagcactccaagccaggtcacctcagcagaagaaaaggatggtcacagtcccatgtccaaaggcttagtcaatggcctcaaggcaggatcaacagccttgggctccaagggtggttccggccctcctgtgtatgtggatcttgcctatatcccaaatcactgcagcggcaagactgcggatcaggacttcttccgccgagtacgtgcgtcctactatgtggtcagtggaaatgaccctgccaatggcgagccaagccgggctgtgctggatgccctgctggaaggcaaggcccagtggggggagaaccttcaggtgactctgattcccactcatgacacggaggtgactcgtgagtggtatcagcagacacatgaacagcagcagcagctgaatgtcctggtcctggcgagcagcagcactgtggtgatgcaggacgagtcctttccagcctgcaagattgagttctgaatgacccatgctcccttccccaaggatccactcctacagttcatttagagaatggctactgctgagtcctctggggttgagggaagtagagctgggcaggggccatgtcatattattaggctaagcggaaggtcctgtccttcccctcctctctccctgggggtttcaaaaccaaaggcaatgagggggcatacaaaatcatgaaaggttatctgatgcccaaaaacccctagagccactccctctcctagcactgccaaatgctggtcttgcacgaggatgggtttcagacagcacactcctccccatggaggaagatttaacaccctctcccccagaacctcattatttatttggcattccagaaaggattgctgataatgtatatgatgcagggaaggccactgttagtaaggtgccagagctgcgcccttttttccatctcccagtccctagccaccagagtctgggttccatcagcgacctggggacatgtggctactatactgtcttattgcttccctcaatatctgaatgtctcaatccaaaacttgaagctctttagaccaagaactagggagaggaaaaaggagctcatctctcagcccctgcttcaaaccacttacagccttgggctgtacccagaccaggctacctgggcagcacaacgggcaaggagagcccccaaccccagtcgctccaagcacccctatcacttagtcttcacctaccccatttcaataagcctcattccttctcatcccctgcttggcttctctgcatgtggtcatctgctatggcctggtgtgtaatgggtttaaaaaaagccactgcctgacatccacatccactttagccatgtgtgactccctcaacattccaatcctctaccatcctgcagctgaaatgggaacactggctgcctctctaaacctaaactcttggatagagtttctgggaggtggaggctggactagagacctggggagggggatgggagggaggaggggagagaagagaagaagctatagtttaactcctccagagtgaagacaggctgagcattctactacaggacagggcctcaccccaagcaagccagtgagcagcccagccagaccctgctggactgagaaacccagctgctgacagaccctgggacttgccttctttgccaagtcaaggggaaaccaaaaggagcttccctcctattcttcctagctcccctccctgccctggctctgctcctccccacacttccctgctacagtcccagttgctgtaacagccacctccactctaacaataaaccaagttcattgcggaaaaaaaaaaaaaaaa

SEQ ID NO: 2212 - DNA, 2956 bp, Rattus norvegicus
  Genbank Accession No. NM_031005
gaattcggcacgaggtcagcagcaacctcctcgagcagagccgcggcggaagcgggctcaggggagcgagcccggccccgccagcccagcccagcccagcccagcccagcccaaccctgccgactccctccccacgcccgggtagcagccgccgtcgcctggagagaaggtggagaaagaaatctagcccctagcacgcacgcaccatcatggaccattatgattcccagcagaccaatgactatatgcagcctgaagaggactgggaccgggacctgctcctggatccggcctgggagaagcagcagagaaagaccttcacggcctggtgcaactcccacctgcgcaaagcagggacccagattgagaacattgaagaggacttccgagatggcctgaagctcatgctgctcctggaggtcatctcaggtgagcgtttggccaagccagagagaggcaagatgcgagtgcacaagatctccaacgtcaacaaggccctggatttcatagccagcaaaggggtcaagctggtgtccattggagctgaagaaattgtggacgggaatgtgaagatgaccctgggcatgatctggaccatcatccttcgttttgccatccaagacatctctgtggaagagacatcagctaaagaagggttgctcctgtggtgtcagaggaagacagccccatataaaaatgtcaacatccaaaacttccacatcagttggaaggatggtcttggtttctgtgccttgatccaccggcaccggcccgagttgattgactatggaaagcttcgaaaggatgatccactcacaaacctgaacacagcctttgatgtggcagagagatacctggacattccaaagatgctggatgcagaagacatcgtcggaactgcccggccagatgagaaagccattatgacctatgtgtctagcttctaccatgccttctctggagcccagaaggcggaaacagcagccaatcgcatctgtaaagtgttggccgtcaatcaagagaatgaacagcttatggaagactatgagaagctggccagtgatctgttagagtggatccgccgcaccatcccatggctggagaatcgggtgcccgagaacaccatgcaggccatgcagcagaagctggaggacttccgagactaccgacgcctgcacaagccgcccaaggtgcaggagaagtgccagctggagatcaacttcaacacactgcagaccaagctgcggctaagcaaccggcctgccttcatgccctccgagggcaggatggtctcggatatcaacaatgcctggggctgcctggaacaggcagagaagggctacgaggagtggttgctgaatgagatccggaggctagagaggttggaccacctggcagagaagttccggcagaaggcctccatccatgaagcctggacagacggcaaagaagccatgctgcggcagaaggattatgagacggccaccttgtccgagatcaaggccctactcaagaagcacgaggcctttgagagtgacctggctgcccaccaggaccgcgtggagcagatcgcggccattgcccaggagcttaatgagctggactattatgactcaccaagtgtcaacgctcgatgccaaaagatctgtgaccagtgggacaatctaggggccctgactcagaagcggagggaagctttagagcgaacagagaagctgctggagaccatcgaccagctatacttggagtacgccaagagggctgcacccttcaacaactggatggagggagccatggaggaccttcaagacaccttcatcgtacataccattgaggagatccagggactgaccacagcccatgagcagttcaaggctaccctcccggatgcagacaaggagcgcctggccatcctgggcatccacaatgaagtgtccaagattgtccagacctatcatgtcaacatggcaggcaccaacccctatacaaccatcacacctcaggagatcaatggcaaatgggaccatgtacggcagctggtgccccggagggaccaggctctaacagaggagcactcgaggcagcagcacaacgagaggttacgcaagcagtttggggcacaagccaatgtcatcggaccctggatccagaccaagatggaggagattgggaggatctccattgagatgcacggtaccctggaggaccaactcagccacctgcggcagtatgaaaagagcatcgtcaattataagccaaagattgaccagctggagggcgaccaccagctcatccaggaagcacttatcttcgacaataagcacaccaactacacaatggagcacatccgtgtgggctgggagcagctgctcaccaccattgccaggaccatcaatgaagtggagaaccagatcttgacccgggatgccaaaggcatcagccaggaacagatgaacgaattccgggcctccttcaaccactttgaccgggatcactccggcacgttgggtcccgaagagttcaaagcctgcctcatcagcttgggttatgatattggcaacgacccccagggagaggcagaatttgcccggatcatgagcattgtagaccccaaccgcttgggggtagtgacattccaggccttcatcgacttcatgtcccgagagacggctgacacagatacagcggatcaggtcatggcttccttcaagatcctggctggagataagaattacatcaccggggatgagctgcgccgcgagctgccacctgaccaagccgagtactgcatcgcgagaatggccccctacgcgggccctgactccgtgccgggtgctctagactacatgtccttctccacggcgctgtacggcgagagtgacctctaacccacccctgcctccccccaccctggccttctgcgcgtgcgccccaccctgctcctgctccgcccagt

SEQ ID NO: 2213 - DNA, 2048 bp, Rattus norvegicus
  Genbank Accession No. NM_031010
gggagaaatcatctgcaagatgggtgtctaccgcatccgcgtctccaccggagactccaagtacgcgggctccaacaacgaggtctacctgtggttggttggacagcatggagaggcatctctcgggaagctgctacgaccctgtcgggactcggaagcagaattcaaagtggatgtgtcagaataccttgggccactgctgttcgtaagagtgcagaaatggcattatctcacggatgacgcctggttctgcaactggatttctgtgaagggccccggagaccaaggatcagagtacatgttcccctgttaccgatgggttcagggcagaagcatcctgagcctccctgagggcactggctgcaccgtggttgaagattctcaaggactgttcaggaaacatagggaagaggagcttgaagagaggaggagtctgtacaggtggggcaactggaaggatggctcaatcctgaatgtggcggcggccagtatatctgacctccctgtagaccaacgatttcgagaggacaaaagaattgaatttgaagcttcacaggttataggggtaatggatactgttgtcaactttcctataaacactgtgacctgctggaaaagcctagatgacttcaactgcgttttcaagagtggccataccaaaatggctgagcgggttcgaaactcctggaaggaagatgcgttctttgggtaccaattcctcaatggtgctaaccccatggtgctgaagcgctctacttgtcttcctgcccgcctggtattccctccaggaatggagaagctacaggcccagctgaacaaggagctccagaaaggcactctgtttgaagcggatttcttccttctggatgggatcaaggccaatgtcatcctttgtagccagcagtacctggctgcccctctcgtcatgctgaagctgatgcctgatggacaactcttgcccatagccatccagcttgaactgcccaaaactgggtctactccaccacctattttcacgccctcggatcccccaatggactggctcctagccaaatgctgggtccggagctccgacttacagctccatgagctgcaggctcatcttctgaggggacacttgatggctgagctctttgctgtggccaccatgaggtgcctgccttccgtgcaccctgtttttaagcttctagttcctcatctgctttacaccatggaaattaatgtccgggccaggagtgacctgatctcagagagaggcttttttgacaaggcaatgagcacaggtgggggaggccacctggatcttctcaagcaagctggagcctttctgacctattgctcattgtgtccccccgatgacttggctgagcgaggactcttggatatcgagacttgcttctatgctaaagacgccctgcgactctggcagatcatgaatcggtacgtggtgggaatgttcaatctccactacaagaccgacaaagctgtgcaagacgactatgaactgcagagctggtgtcgagagatcactgacattggtcttcaaggggcccaggacagaggcttccctacctctcttcagtcccgggctcaggcttgctacttcatcaccatgtgcatcttcacgtgcaccgcacagcactcttccgtccatcttggccagctggattggttctactgggttcctaatgcaccctgcaccatgcggctgccaccacccaccaccaaggaagcaacaatggagaagctgatggctacactgcccaaccctaatcagtctactctccagataaatgtcgtttggctcctgggcagacgccaggctgttatggtgcccctgggccagcattcagaggaacactttccaaaccctgaggccaaggctgtgctgaagaagttcagagaggaactggctgccttggataaggaaattgagattcgtaataagagcttggacataccttatgagtacctgcggcccagcatggtggaaaacagcgtggccatatgagcatccccagactcctgctttgttgtttagttaagac

SEQ ID NO: 2214 - DNA, 3102 bp, Rattus norvegicus
  Genbank Accession No. NM_031011
cggggaaagcagcggactacaagagactgaactgtatctgcctctatttccaacggactcacgttcaactttcgctcacgaaaatagccgggaaaattttattagtcctttttttaaaaaaagttaatataaaattatagcaaaaaaaaaaaaaggaacctgaactttagtaacacagctggaacaatccgcagcggcggcaggagcggcgggagaagagtttaatttagttgattttctgtggttgttggttgttcgctagtctcacggtgatggaagctgcacattttttcgaagggaccgagaaactgctggaggtctggttctccagacagcagtccgacgcaagccagggatctggggaccttcgtaccatcccaagatccgagtgggatgtccttctgaaggatgtgcagtgctcaatcataagtgtgacaaagactgacaagcaggaagcttatgtactcagtgagagtagcatgtttgtctccaagagacgtttcattttgaagacatgtggtaccaccctcttactgaaagcactggttcccctgttgaagcttgctagggactacagtgggtttgactcgattcaaagcttcttttattctcgtaagaatttcatgaagccttctcaccaagggtacccacaccggaatttccaggaagaaatcgagtttcttaatgcaattttcccaaacggagcaggatattgtatgggacgtatgaattctgactgttggtacctgtacactttggatctcccagagagccgagtaatcaatcagccagatcaaaccctggaaattctgatgagtgagcttgacccagcagttatggaccagttctacatgaaagatggtgttactgcaaaggatgtcactcgtgagagtggaattcgtgacctgataccaggttctgtcattgatgccacactgttcaatccttgtggctactcaatgaatggaatgaaatcggatggaacatattggactattcacatcactccagaaccagaattttcttatgttagctttgaaacaaacctaagtcagacctcctatgatgacctgatcaggaaagttgtggaagtcttcaagccaggaaaatttgtgaccaccttgtttgttaatcagagttctaagtgtcgcacagtgctttcttcgccccagaagattgacggtttcaaacgtcttgattgccagagcgctatgttcaacgattacaattttgtttttaccagttttgctaagaaacagcaacaacagagttgattaggaaaaatgaaaaagaaaaaacgcaaaaagagaagacacacaggaggtggtggctgctttctagatgttgatcctgggggccatgctgaccgtgaccaccaccttgtagctgcagaaagccctaggtgtaatgatagtgtaatcattttgaagtgtatgcattattatatcaaggagttagatatcttgcatgaatgctctcttctgtgtttaggtgttctatgccactcttgctgtggaactgaagtgcatgtagaaaagaactctgactgtatgaatctttacgacacttgtgaaaacgattcgacttggtttatgcacagcgtaatatttctgcaggcatcgtccaaaatcccccacagacaaggctttcgtccccattagatgcggcctcagctgaccattggcgactgttctatttgctgccagagtttttacatccagttacctccactttctagagcatattctctactaatgttcaaaaccgatttctacttcatacgggtgtcttatgcaatggcaattaaagttttcttccacaagttgagtctttgtaaggaaatgattccagttgcttgttttgtgttctactgttttagtaattgctcctgcatttatagtcctatggtttttcactacccctgatgaagcaatacacggtcacactgtgggcttacattgtaatcttcaccccagatgggagctcagagacggtcccttgctcatttttccctaagatgtagaatgtggccttgctattggcatgcccttctgtggaagataaatgatggaagtgaaagtatcccgggggtgagcaaggagaaccaccccatggcagtgatgggcttggcagtgcactccgagctctcacagtggagtgcccaccatgccttcactaactcactgagcagtgataggatgcccaccaagtcagagcagaaatctaaccctaaggattctcacctcggtaagtgccgccattgccaccactttactaaaggaagtttccgctcagaggagagtctgtacttcccgcctgtcctaatgtcagctgttctctctggtctttcaccatggcgttcagatgctcaaatgaatggctgatcggccgcagggaggactctccgggttactgggcctggagaatggagaaacaggcacggtattctgacagttaatggcaccagagatgcgggctttcaagagctggcctgttagtggcatttttaagcagaaaagagcaaactagacgaagttccctatttattgccctcccactgtttccttggcagtttctggactggcgcaatgatgccttgttccttccgtatttataacgaagctaaaaagcgtttctaagcatggagtctacttggtttgaaatcaagtggttggaacactgtctggatttttactttacgcagtgttgattgaacgcttcgttggggaagccttcagtccgcttcatcggtctgttctgtaatgagcacagcacacctagtttgaattgctgtttggagggccagtgcttatttgagctgggtcttgtaacccagtagattttggcttgaggtctgactcccccatcttacgaaattaagaattctaatgttggaaattgcatagggtttgcgtggaaaaaagcccagggaaaaaaaaaaaaaaacagaaggcggactagtgatctagtgtgattacaggcggggaagttttggtgccataatttctttgttggtgttggacttttaatcagctgaaatgtatttctgtaccacaatgtaagcttcaataaaagtttgcttaattgtctagtaacatccag

SEQ ID NO: 2215 - DNA, 3320 bp, Rattus norvegicus
  Genbank Accession No. NM_031012
ctccctgcccaccagcatcatggccaagggtttctacatttccaagaccctgggcatcttgggcatcctgttaggtgtggcagccgtatgcaccatcatagctctgtcggtggtctacgctcaggagaagaacaggaatgcggagaactctgccatagcccccacgctcccaggcagcacctcagccaccacctcaactaccaaccctgctatagatgaaagcaaaccttggaaccagtatcgcttgcctaagactcttatacccgactcctaccaggtgaccttgaggccttacctcacccccaacgagcagggcctgtacatcttcaaaggttccagtactgtccgctttacctgcaacgagaccacaaatgtcatcattatccacagcaagaagctcaactacaccaacaaagggaaccacagggtggcgttgcgagccctgggtgacactccggcacctaacatcgacacaacggaactggtagagcgcacggagtacctggtggtgcacctgcagggctccctggtaaagggccatcagtacgagatggacagtgagttccagggggagctggctgatgatctggctggcttctaccgcagcgagtacatggaaggtggcaacaagaaagtggtggccaccacacagatgcaggctgccgatgctcgaaaatcctttccttgcttcgatgagccagccatgaaggcctcattcaacatcacgctcatccaccccaacaacctcaccgctctgtctaacatgcttcccaaagattccaggacccttcaggaagatccttcctggaacgtcactgagttccaccctaccccgaagatgtccacatacctgctggcctatatcgtgagcgagttcaaatatgtagaagccgtctcacccaatagagtccagattcgaatctgggctcggcccagtgccattgatgagggccatggtgattacgctctgcaagtcacaggccctatcctaaacttctttgcccaacattataatacagcctaccctctagaaaaatctgaccagattgccctgcctgacttcaacgctggagccatggagaactgggggctcgtgacctaccgagagagtgccctggtctttgaccctcagtcctcctccattagcaacaaggagcgggtggtcactgtgattgcccatgagctggcccatcagtggtttggcaacctggtgaccgtggattggtggaatgacctgtggctgaacgagggctttgcctcctatgtggaatttctgggtgctgactatgcagagcccacctggaatctgaaagacctcatagtactgaatgatgtgtaccgtgtgatggccgtggacgcgctcgcttcctcccacccgttgtccagccctgccaacgaggtcaacacgccagcccagatcagtgagctgtttgacagcatcacctacagcaagggagcctcagtccttaggatgttgtccagcttcctgacagaggacctgttcaagaagggcctttcgtcttacctccacaccttccaatactcgaacaccatttatctggacctgtgggaacaccttcagcaggcagtggacagtcagacagctatcaaactcccagcctcagtgagcaccatcatggaccgatggattctacagatgggttttcctgttatcactgtgaacaccagtacgggagaaatctaccaggaacacttcctcctggaccccacttccaaacctacccgcccctcagattttaattacctctggattgtgcccattccgtatctcaaaaatggaaaggaggatcactactggctggagaccgagaaaaaccagagtgcagaattccaaacatcctccaatgaatggctcttactgaacattaatgtaaccggctactaccaggttaactatgatgaaaacaactggaggaagattcagaatcagctgcaaacagacctttctgttatccctgtcatcaaccgtgcgcagattatccacgactccttcaacctagccagtgctggaaagctatccatcactctgccgctgagcaacaccctcttcctggccagtgaaacagaatacatgccctgggaggctgccctgagcagcctgaactacttcaagctcatgtttgaccgctcggaggtctacggccccatgaagcgctatctgaagaagcaagtcacacccctcttcgcctacttcaaaatcaaaaccaacaactggctcgaccgtcctccaacactgatggagcagtacaacgaaattaatgccatcagcaccgcctgttctagtggtctcgaagagtgtagggatctcgttgttgggctttatagtcagtggatgaacaactctgataataacccgatccaccccaaccttcggtctactgtctactgcaatgccattgctttcggtggtgaggaagagtggaactttgcttgggaacagttccggaaagcaactctggtgaacgaggcagataaactccgctcagccttggcctgtagcaacgaggtgtggattttgaacaggtacctgagttacactctgaaccccgactacatccggaagcaggatgctacctccaccatcgtcagcatcgccaacaacgtggttggacaaactctagtttgggactttgtccgaagcaactggaagaaactgtttgaagattacggcggaggatctttctcctttgccaatctcatccagggagtgacccggcgcttctcctctgagttcgagctgcagcagctggagcagtttaaagaggacaactcggccacaggctttggctccggcactcgggctctggagcaagccctggagaagactaaagccaacatcaagtgggtgaaggagaacaaagacgtggtactcaagtggttcacagaaaacagctagttagtcccgggccgagaaccatctgtcccggcgtgacgcctatgactatctcagcagcctgtgcagggtctctgtcttcagagcgccagacaccggcatctgaccctcaaggtcaaagtctccagcctatggagctagcctagctcctaattgtcagactgccagacacctcccggtccttgcccctcgtgccaactctgccccaggcccaggcctctggggctgatctcagggaagcccagctctgagtctagatttactggacaaagggtagcctagaaagagtctccctgaatgccttactactttccccccacaagacccagaaccaaagaatcaacagggcacaaagatctatatatatttttaagagaaaatgtaaataaagaatttctaaaatgag

SEQ ID NO: 2216 - DNA, 2483 bp, Rattus norvegicus
  Genbank Accession No. NM_031016
tcgatccaatggatttcttggtttcctgtatggaatgttaacaatctgtgttatacactattgagatgcagacgtggcttcctttggcccaacactttggaggccaggattcattgtctatctctgtttgcttgaagcccaacccaccacgagccaatcctttgtcttgttctgtgtctcatagtacttttttccttggttccttctgtgcctggtaatttccgcagcggccacaacttcattaagagagaaactgtcaagttcaagaaggaagtgaagttggtctaacataccacagaaatttttctcaaaagaatcagaaaaaagggaagtacatcggcatgtttggaagggggatgccttcaaagatctttctttactgttgctgtctttgccggaattccgcgacaggtttaaatgtttctttggccacttgactactgaacacaaaatgaataactcaacaaactcctcgaacaatggcttggctattaccagtccttacaagacatttgaagtggtatttattgtccttgtggctggatccctcagtctggtgaccatcattgggaacattctggtcatggtttccattaaagtcagccgccaccttcagactgtcaacaattacttcttgttcagcctggcctgtgctgacctcatcataggtgttttctccatgaacttgtataccctctacactgtgattggctactggcctttgggacctgtagtatgtgacctatggctagcattggactatgttgtcagcaatgcctccgttatgaatctcctcatcatcagctttgatagatacttctgtgtcacgaaacctctgacctacccagttaagcggaccacaaaaatggcaggcatgatgattgcagctgcgtgggtcctttccttcatcctctgggccccagccattctcttctggcagttcatcgtaggggtgaggactgtggaggatggggaatgctatattcagttcttttccaatgcggccgtcaccttcggcactgccattgcagcgttctatctgcctgtcatcatcatgactgtgctctattggcatatatcccgggcaagcaagagtagaataaagaaggaaaagaaggaacctgtggccaaccaagacccagtatctccaagtctggtgcaaggaagaattgtaaagccaaacaataacaatatgcctggtggtgatggcggcctggaacacaacaagatccagaatggcaaggctccacgggacggcgtgactgaaacctgtgttcaaggggaggagaaagagagctccaatgattcgacgtcatcagctgctgtggcctccaatatgagagatgatgagataacccaggatgaaaacacagtttccacttcgctggaccactccagagatgacaactctaagcaaacatgcatcaaaattgtcaccaaggcccaaaaaggtgatgtgtacaccccaacgagtaccactgtagaactagttgggtcgtcgggtcagagtggggatgaaaagcagaacgttgtagcccgcaaaatcgtgaagatgcccaagcagcctgccaaaaagaagcctccaccatcccgggaaaagaaagtgaccaggacaatcttggctatcctgttggctttcatcataacgtgggcgccatacaatgtcatggtgctcatcaatactttctgtgcaccctgcatccccaatacagtatggacaattggctactggctctgttacatcaatagcaccatcaatccggcctgctatgcgctttgtaatgccaccttcaaaaagacttttaagcacctcctcatgtgtcattacaagaacataggcgctacacggtgaaaagaccatcaaaagaagaaatgtggtcgagtgtgtcttggggaagaacagcgaccagaaagctgtgtttatagtgacctgccatttcactttacagtcttactgcaacatgaaagtaaggagttttagagagacactatcattgcgcccatgctccgttttggaaagactaccttattaaactctcaccttataaaccctgtcagtttaggagcaccgagaaattgaaagaggcatgctgaaactgcagatctaaggaaaaatctctactgtctcctgctctcttgaagaagggcgtcagagtctacaatttcatgtctctgcacaagaagaataacctagtctatttgttgtttctttctgttgttcccctgtgtggcggtgagaaagaaatgacacattccatgctaacacagagacctacatggaaagaagcaggcactgtacaatgagagagaagaagaaagaaaatcaaataggatgcagagatggtctgcagagcacgagcatatatatcctcggctgtgctgtgctctgatcggaaggatttcaacacaacaacctgcttatttcttctctcttgccccctcccctgccgatggaaatcaagaaagccaacaacaaccagtcg

SEQ ID NO: 2217 - DNA, 1125 bp, Rattus norvegicus
  Genbank Accession No. NM_031017
gaaagcagtgactgaggagcttgtaccaccggtgactagatgaccatggactctggagcagacaaccagcagagtggagatgctgctgtaacagaagctgaaagtcaacaaatgacagttcaagcccagccacagattgccacattagcccaggtatccatgccagcagctcatgcgacgtcatctgctcccactgtaaccttagtgcagctgcccaatgggcagacagtccaggtccatggggtcatccaggcggcccagccatcagttattcagtctccacaagtccaaacagttcagtcttcctgtaaggacttaaaaagacttttctccggaactcagatttcaactattgcagaaagtgaagattcacaggagtctgtggatagtgtaactgattcccaaaaacgaagggaaatcctttcaaggaggccttcctacaggaaaattttgaatgacttatcttctgatgcaccaggggtgccaaggattgaagaagaaaaatcagaagaagagacttcagcccctgccatcaccactgtaacagtgccaaccccgatttaccaaactagcagtgggcagtatattgccattacccagggaggagcaatacagctggctaacaatggtaccgatggggtacagggcctgcagacattaaccatgaccaatgcagctgccactcagccgggtactaccattctacaatatgcacagaccactgatggacagcagattctagtgcccagcaaccaagttgttgttcaagctgcctctggtgatgtacaaacataccagattcgcacagcacccactagcaccattgcccctggagttgttatggcgtcctccccagcacttcctacacagcctgctgaagaagcagcacgaaagagagaggttcgtctaatgaagaacagggaagcagcaagagaatgtcgtagaaagaagaaagaatatgtgaaatgtttagagaacagagtggcagtgcttgaaaaccaaaacaaaacattgattgaggagctaaaagcacttaaggacctttactgccacaagtcagattaatttgggatttaaattttcacctatgtggtggaaaatggactggattggccacaaccagaa

SEQ ID NO: 2218 - DNA, 2697 bp, Rattus norvegicus
  Genbank Accession No. NM_031024
gtcggtccgcccgtgcgtgcgtctgtccgttcggcctccgtccggcccgcagcatggccggcgtcagcttcagcggccaccgcctggagctgctggcggcgtacgaggaggtgatccgggaggagagtgcagccgactgggctctgtacacttacgaagatggctcagatgacctcaagcttgcagcatcaggagaaggaggcttgcaggagctttcaggccacttcgagaaccagaaagtgatgtacggtttctgcagcgtcaaggactcccaggctgccttgccaaaatatgtgctcatcaactgggttggtgaggatgtgcctgatgcccgaaaatgtgcttgtgccagccatgtggccaaggtggctgaattcttccagggcgttgacgtaattgtgaatgccagcagtgtggaggatatcgatgctggcgccattgggcagcggctctccaatggactggctcggctctctagcccagtgctgcaccgcctgcgccttcgggaggatgagaatgctgagccggtgggcaccacctaccagaagacggatgcggccgtggagatgaagcggattaaccgtgagcagttttgggagcaggccaagaaggaggaggagctgcggaaggaggaggagcggaagaaggctttggatgccaggctcaggtttgagcaggagcggatggagcaggagcggcaggagcaggaggaacgggaacggcgctaccgagagcgggagcagcagatcgaggagcacaggaggaaacagcagagtctggaagctgaagaggccaagaggaggttaaaggatcagtctatctttggtgatcagcgagatgaagaggaagagtcccagatgaagaagtcggaatctgaggtggaggaggcagctgccatcattgcccagcggcctgataacccacgggagttcttcagacagcaggaacgagtggcttcagcctctggtggcagctgtgacgcaccctcgcccttcaaccaccgaccaggtcgtccgtactgccctttcataaaggcatcggacagtgggccttcctcctcctcctcttcctcctcttcccctccacggactccctttccctatatcacctgccaccgcaccccaaacctctcttcctccctcccatgcagtcacctggacagccaccggaggatggcgcccactcccattcccacccggagcccatctgattccagcacagcctccacccccatcacggagcagatcgagagggccctggatgaggtcacatcctcgcagcctccacccccacctccaccacccccaccagctcaagaggcccaggagtctgctcccagactggacggtgaagaggtctgcaaggaggccaaagtagcagcagctcctcaggtctgggctggctgtgcagaggagcctcctcgggcacaggaacctcccctgttgcaaagcagccccacggaggacttgatgtgcacagaatctcctgagcaggctgtcctggcggcctctccagagcctgatgcctctgtcacctcagtagctgatgctcatgcagctgacaccatcgagaccaccactgccactactgccaccactattgccgacaacgtcacccctgccgccgccagcctcattgatctgtggcctggtaacggggaagaggcctcaacgcctcaggctgaacccagggtgcccaccccaccctcaggtgctgaggcctccctggcagaggtgcctctgttgaatgaggcagctcaggagccgctgccaccagtgggcgaaggctgtgccaaccttcttaatttcgatgagctgccagaacctccagccaccttctgtgacccagaggaggaagccgaaggagagccgctggctgcctcccaggtcctaactatgccctcagccctagaggaggtagatcaggtgttggagcaggagttggagccagaacctcatctgctgaccaatggagagaccactcagaaggaggggacccagcaggccagcgaaggatacttcagtcagtcacaggaggaagaattcgcccaatcagaagagccatgtgcaaaggctccacctcctgtattctacaacaagcctccagaaatcgacatcacctgctgggatgcagacccagttcctgaagaggaagagggcttcgagggtggtgattagtagtggcgactgccccctggctgccctcgccaaggctgcccacctgcagtgcctctggccagccggcttgcagcgccagcattagcagcagccccgcctggctcccactctggattccggcactggccggggacctgtctgcttctctacccacagggcctgacttttacagcttttctcttttttttaaaagttgatagacttgtacaattgactggttttcctcccgttggtagttgaaacaatgttgcagattccacccccttcctgcccagaccagattgtagcttagtccttcctgctcagctgaccagggtggaggcctcaccctgcttgggacctggtgggggtcgggggttctggtgggaaaatgttcccccccatcacttttcctagttttatgtttcttggaaaaaaaatatcactttgtattctctatccagggcttcagatattttgcacgaaatttaaaacatggcaataaatggctcgtgggctctgaaaaaaaaaaaaaaaaaaa

SEQ ID NO: 2219 - DNA, 4300 bp, Rattus norvegicus
  Genbank Accession No. NM_031026
gcaagatggcgccggtgggggtggagaagaagctgctgctgggtcccaacgggcccgcagtggcggctgccggcgacctgaccagtgaagaggaggaaggccagagtctatggtcttcgatcttgagcgaagtgtccacccgcgccaggtccaagctgccgtccggcaagaacattctggtgttcggtgaagatggttctggtaaaacaactctcatgaccaaactccaaggagcagagcacggcaaaaaaggaagaggcttagagtatctttacctcagcgttcatgatgaggaccgtgatgatcacacgcgctgcaatgtatggattttggatggagacctttaccacaaaggcctgctgaaatttgcagtttccgcggagtctttgcgggagaccctggtcatttttgttgcagacatgtctagaccttggactataatggaatctctacagaaatgggctagtgttttacgggagcacattgacaagatgaaaattccaccagaggaaatgagggatctggaacggaagtttatgaaagattttcaagattatatcgagcctgaagaaggttgtcagggttccccacagagaagagggcctctgacctcaggctcagatgaagacaatgttgccctccctctgggtgacaatgtgctgactcataacctggggatcccagtgttggttgtgtgcacaaagtgtgatgcagtgagcatcttggagaaggagcacgattaccgagacgagcacctggacttcatccaggcgcatctgcggggattctgcctccagtatggagctgccttgatttacacctcagtgaaggaagagaaaaaccttgacttgctgtataagtacattgttcataaaacatacggcttccacttcaccatacccgccttagttgtggaaaaggacgcagtttttatacctgcaggatgggacaatgaaaagaaaatagctattttacatgaaaattttacaaccgtgaagccagaagatgcatatgaagattttattgtaaagcctcctgtgagaaagctggtccatgacaaagagttggcagctgaggatgagcaggtgttcctgatgaaacaacaggaatcccctgccagaggaccctctggctctccaaggacgcagggtcggggtggaccagctagtgtaccaagcgcctccccaggaacatcagtaaagaagccagatccaaacatcaaaaataatgcagcaagtgaaggggtattggccagcttcttcaatagtctgttgagtaaaaagacaggctctcctggaagtcccagtgctggtggagtgcagagcacagccaagaagtcaggtacagaaggagagccccagagcttcagatccttaacagaacagtgctgtcaaacaggacaaaagactgtgttgtcaaacgttcaggaagaactggatagaatgactcgaaaaccagactccatggtaacgaactcttcaacagaaaacgaagcctgaccctcctttgaaagtgcatatgtcaaatgaccaaatacctatgtatattcatctgataagaccaggatttttctgatatggcacatgctatcagtttttggggtaggggagatgaactttaaaaaaatacatatacttcattggcttgtccgagtgtgaagtgcacatttaggacggttttgtgtcaggccccttgttagggacgtcccttggactcttgggctgcgattctcttgtgggaagtaagcgcagctgggcttgtagagtggagagaggaggcccactttctgtcagagtggagcgaacgagactaggaagtcagatggatggtttgaccagttgcgtgttagcaaattcacttgttcttgggaagcaggttaagtagcagaaagtcaggaaagagaaaggttcaagaaggacaagagaagtgcttgtggggaagctgatggttgaaggagatggaggaaagaagtgagtgagcgagagagcagcattaatgagtacgtacatgcacagtagaaaccaaatagcatcagttaagacctaacaattagaaacatttccaagctaagcactaaacagaatgggaactggacttgttctgattgcatctttaagttatgggaaatgtgttttatttgtggtgcctcaggaaggtgggctgactcgagtggtgaagcccgcagctacccaggacccacatgcttggcccaggccatgtcccttgtccttgaaaagatgctgggctctatgcacaggtaacctggggcaggcggtcactgtgttatgttcaaagtcagcagatacaaaattagatattttaaatagttcctgttctgttttgtttaattgttactttaactaccacaggctggcaactaatagaaatgggtggttgattgctcattggaccggtattggcaatgtcctatagcaagtttgggggaagtatttactgtcactgtattctggctatttggcttgtgccagttgctgccttagagcctgtggtaactttccctgatacagaaaggttctttctgtagctccctggtcgaatcgttgctgacagaccgaaaagtgggtgctttacgtggagaatggaaggggtaggcttgtgtttgtcataaactgtagcgcttctcttacaggcgtgtgagttttacgtgtcttccattaggggcatgttcatgaacactgtcaagtcacaccaccatgctgaggataacctctgtagattggagacagcactttgagttttctgtgtgacacagcacatgtaaatgcaaacactaccatgactttaatgtataaaatatttgtcatccaaaccaaggggaaaaaccacagttcacttccgtggagtttacttttttatatgaatgtttgttgttgtgtctcggcataatgttcctaatgtcattacatacatgccagatttgactaaccactaacgtagttctgggcgtaagttaacatctcgttatgtgacgaggctcctcgactgggagtcactttgtaaaggtcggaacactgttaaggaggaagcagcgtgctaacttgcctctctaacaacaaaaagatgtttcttgtgccggttttactattgaaatatattttttccttttttaattcagtttttttgttgttattttgtttttatttttttaaacatgcattgtggcttcaaatgaccaggttgtccaggcgatgacaggaagctggctggagtagaaactgtggtaaaggatcacctgatctctgtagcagccagggcaaaatgagtgacctcagaaactaggaattcttgcaaagacatgtgcctaatagtgtgacttttaaattttgatacatttaaagtgtatcatttgaacggctaggcacttttggtgttggtgtcagttgtgctctaatcaacatgactcttctagaggagactgatgcatgttactgtgtgctcaggagttgccaaagtcaccagctttgggaagcttccaggttctttaggggtttgaggagatgaggtgatttttattattttaggattctcaagcattggaaccaaaggccaaataataaacagcctttactttttaaagtaaaattaattttatttgcaagaatacacttgtatggtagactataacagacaattttatgactatttatacacattataatgattacctctgtttgtctttaagtggataactttaagagcccaacctaaaaattatagcccaaatgagggctatgaattggtctttcctaaaaatccaacagatatgctgctagattattttgttttatttgcacttttttttttcttaaataacagagagggtttctttgtattgccctggctgtcctggaactcattctgtagaccaggctgccctccagagatccgcctgcttttgcctcccaagtgctgggattggcttgtgctactgtgcacagctgcaccttttttctcttttactttttttttaattggcgttttaaaaacagtattgaaactgaaaagactgtcttctgaacttggtgaaggtgaaagtgacctctgtacatcgtgaccttaacaatgctgatgctgtaagtgaaagttcactgttgtctctctgctaagttcattggtgtttttaacctaaaattaggactgcagatgatcgcccactagccttagtccaggatgtggctctgtctgggtgcagtatgcagtcatgtggaaccttgctttctagtgctgggggaaaagatgtctaactactggcttcaataaacaagaatccagactgcta

SEQ ID NO: 2220 - DNA, 1423 bp, Rattus norvegicus
  Genbank Accession No. NM_031034
aggccggggcccgcgcgccatggacgcccctcagccggcgcggcgcggccgcggcctgagggcggtcatgtccggggtggtgcggaccctcagccgctgcttgctgccggccgaggccggagcccgcgagcgcagggcgggcgcggcgcgcgacgcggaacgcgaggcccgacggcgcagccgcgacatcgacgcgctgctggcccgcgagcggcgcgcggtgcggcggctggtcaagatcttgctgctgggcgccggcgagagcggcaagtccaccttcctcaagcagatgcgcatcatccacggccgggagttcgaccagaaggcgctgctggagttccgcgacaccatcttcgacaacatccttaagggctcgagggtgcttgtagacgctcgggacaagcttggcattccctggcagcactctgagaacgagaagcacgggatgtttctgatggccttcgagaacaaggcagggctgcctgtggagcctgccaccttccagctctacgttccagccctgagcgcactctggagagactccgggatcagggaagccttcagccgcagaagcgagttccagctgggtgagtcagtgaagtacttcctggataacttagaccggattggccagctgaactacttccccagtaagcaagacatcctgttggctagaaaggccaccaagggaatcgtggagcatgacttcgtgataaagaaaatcccatttaagatggtggatgtgggcggccagaggtcgcagcgccagaagtggttccagtgcttcgacgggatcacatcgatcctgttcatggtgtcctcaagcgagtatgaccaggtcctcatggaggataggcgcaccaaccggctggtggagtccatgaacatcttcgagaccatcgtcaacaacaagctcttcttcaacgtctccatcatcctcttcctcaacaagatggacctgctggtggagaaggtgaagtcggtgagcattaagaagcacttcccagacttcaagggcgacccgcaccggctggaggacgtccagcgctacctggtccagtgctttgacaggaagcgcaggaaccgcggcaagcctctgttccaccacttcaccactgccatagacaccgagaacatccgcttcgtgtttcatgccgtgaaggacaccatcctgcaggagaacctgaaagatatcatgctgcagtgagacagcccctctgccagtcctctcgtggcctctgtgtggccacatgtctctggtgtgtctgccacctgcatggacctgcagtgggcatctcgaagccacaccatctaatacctggcactaagaatgctggactgtcagccacaccagcgagctgcgggcaagaggatgggagtgtcagtgatagctactgaatcggggactgaaactactgaatcc

SEQ ID NO: 2221 - DNA, 1748 bp, Rattus norvegicus
  Genbank Accession No. NM_031035
ggcgggcgggaaggcgcctcccgcagtcgctcggaactgcggacctgagagcttcccgcagagggccggcggtgggagcggagtgggtcgggcggggccgagccgggccgtgggccgtgtgggggccaggccgggccggcggacggcaggatgggctgcaccgtgagcgccgaggacaaggcggcagccgagcgctctaagatgatcgacaagaacctgcgggaggacggcgagaaggcggcacgggaggtgaagttgcttctgttaggtgctggagaatcagggaagagcaccatcgtcaagcagatgaagatcatccacgaggatggctactcagaggaggagtgccggcagtaccgtgcggttgtctacagcaacaccatccagtctatcatggccatcgtcaaagccatgggcaacctgcagatcgactttgctgacccccagcgtgcggatgatgccaggcagctgttcgcactgtcctgtgctgccgaggagcaaggcatgcttccggaagacctgtcgggcgtcatccggaggctctgggctgaccatggtgtgcaagcctgctttggccgctcacgggaatatcaactcaatgactcagccgcttactacctgaatgacctggagcgcatagcacagagtgactatatccctacacagcaggatgtgctgcggacccgtgtgaagaccacaggcatcgtcgaaacacacttcaccttcaaggacttacacttcaagatgtttgatgtgggtggtcagcgatctgagcggaagaagtggatccactgctttgagggtgtcacggccatcatcttctgtgtcgccttgagcgcgtacgacttggtgctggctgaggatgaggagatgaatcgcatgcatgagagcatgaagctgtttgatagcatctgcaataataagtggttcacagacacctccatcatcctcttcctcaacaagaaggacctgtttgaagagaagatcacacagagccccctgaccatctgtttccctgagtacacaggggccaacaagtatgacgaggcagccagctacatccagagcaagtttgaggacctgaataaacgcaaagacaccaaggagatctacacgcacttcacatgcgccaccgacaccaagaacgtgcagtttgtgtttgatgccgtcactgacgtcatcatcaagaacaacctgaaggactgtggcctcttctgaggggcagtgggcctggcaggatgggccaccgctgactctgctccccactacctgtgaggaagatgggggcaagaagaccatgctccctgcctgttcccccagctgcttctcccctgtctcttctctctgttctcagctcccctgtcccctccctcggctctagacttgggggaggggttgccacaggcctccctgtctaaaacccacctttgtctgaggtgccgggagtggccatggtacctccttactgggcatccattcgggttttctaaccattgtcttgttctgggggtgagcggggagcgcatgcagagtttcccaaggcctatgtctggaggagtaccaattcctccagcctagacccctggctttgtccaacaccagccctgacccaagtccaaatgtttacagggagcctcctgcctaccccactctctgccgcttggaggccccaaaggaaaaagcacaagaagcgtgagagacaccaccattcctggagacaaagcccacctgctcattctcgtagcttt

SEQ ID NO: 2222 - DNA, 1624 bp, Rattus norvegicus
  Genbank Accession No. NM_031043
cagcaccatgacagatcaggcttttgtgacgctcaccacaaacgatgcctatgccaaaggggcgctggtcctgggctcatctttgaaacagcacaggactactaggaggacggttgtactcgccagcccacaggtttcagactccatgagaaaagttttagagactgtctttgatgaagtcatcatggtagatgtcttggacagtggtgattctgctcatctaaccttaatgaagaggcctgagttgggcatcacgttgactaaactccactgctggtcactcactcagtattccaaatgtgtgttcatggatgcagatactctggttctctcaaatattgatgatctttttgaaagagaagaattgtcagcagcaccagacccagggtggcctgactgtttcaattctggagtctttgtctatcaaccctcaattgaaacgtataaccagctgttgcatcttgcttctgagcaaggtagttttgatggtggggaccagggcctactgaatacatattttagtggctgggcaacgacagatatcacaaaacacttgccatttgtgtataacctgagcagcctctcaatatactcctacctcccggcatttaaagcgtttggtaaaaatgccaaagttgtgcacttcctgggacgaaccaagccatggaattacacgtacaatccccaaacaaaaagtgtcaaatgtgaatcccaggacccaattgtgagtcacccagagtttctgaacctgtggtgggacaccttcaccaccaatgtcttacccctgctccaacaccatggccttgtcaaagatgccggttcctatctaatgatggaacatgtcacaggagccttgtcagacctgtcctttggggaggccccacctgcatcacagccttctttgtcctcagaagaaaggaaggaacggtgggaacagggccaggctgattatatgggagcagattcttttgataacatcaagagaaaacttgacacttacctacagtagaagcactgccattttcttgtggacacatccatgtcttaggcacgtttcgatacatagtatgtgaagtctgttacaattgttagaggctttcactaaacctcagcagatgaggggtttgggcaggacaacaggtgagaactgggcaaatgttattaagtaataattctattatgtggacaagtgttgtgtttaaccctagactttttcaaaaactctaaattcttaaattgccaatgtgtgataaagaaaagccaacattgagctactaaattaggctctttcaaatggtgcagaacttgactctccatcttcaaaacaaggtatgagattctccaatatttgcttgttgtatccttcactagacctgcaatgtagaattgttcaaagcctgtcagagaagtagccttctagactaaagtggcctttattaacactgcggagtgattcataagcctaccagctagtgttagttcaccagttttctatgcaccatgaaggcggcatgcagacctgctctttctcagttatctacttgaaaattgcagtgtgctctctgatggtagctgtggaagcactgtgtataacaaataaagacttattgacataaaaaaaaaa

SEQ ID NO: 2223 - DNA, 10708 bp, Rattus norvegicus
  Genbank Accession No. NM_031046
gggacgcagagggagcgcgggccagggaggaggagcgaaggtgtaggacagaacttcgccaggaacaggaaacccacggccgggcaggggcggcgacggcggcgcggggccatcgcagtgtccccagcggtggcctcgctgccgcgtcccgagctgagccgcttggacccctcggactcagaggacccaagctcacccttgcgagcagcggagacagcggggacggcctcacgagcgtgaagcagcatgtctgacaaaatgtccagcttcctctacattggggacatcgtgtccctgtacgcggagggctcggtcaatggcttcatcagcaccctggggttggtggatgaccgttgtgtggtgcacccggaggcgggggatcttaccaacccacccaagaagttcagagactgcctcttcaaggtgtgccccatgaatcgatactctgcccagaagcagtactggaaagccaagcaggcgaagcagggaaaccacacggaggctgccctgctgaagaagctccagcacgccgcagagctggaacaaaaacagaatgagtcagagaacaggaaacttttgggagaaattgtgaaatacagcaaagttatacaactactgcacataaaaagcaacaagtacctcaccgtgaacaagaggttacctgccttactggagaagaatgccatgcgtgtgtccctggatgctgcagggaacgaagggtcctggttctacatccatcccttctggaagctgagaagcgagggtgataatatcgtcgtgggagataaagtcgttctgatgcctgtaaatgctgggcagcccctgcatgccagcaacgtggagctcctggacaaccccggctgcaaagaggtgaatgctgttaattgcaacactagctggaaaatcactttattcatgaagttcagctcctaccgagaggatgtattaaaagggggtgacgttgtgagactgtttcatgcggaacaagagaagtttctgacctgtgatgactatgagaaaaaacagcacattttcctgcggacgaccttgcgtcaatcagcaacgtcggccactagctctaaagcactctgggagatagaggtggttcaccatgatccatgccgcggaggtgcaggacagtggaacagcctgttcaggtttaagcatcttgcaactgggaactacttagctgcagagcttaaccctgactatcgagatgctcaaaatgaaggaaaaactgtgagagacggggagcttccaacctcaaagaaaaaacaccaggcaggggagaagatcatgtacacgctggtctcggtcccgcacggaaatgacatcgcgtccctttttgaacttgacgccacaactctgcagagagctgactgcctggttccgaggaactcctacgtgcggttgaggcacctgtgtaccaacacgtgggtaacaagcaccagcatccccatagacacggaggaagagaggcctgtcatgctgaaaattgggacctgccagaccaaggaagacaaagaagcctttgccatcgtgtgcgtcccgctgtctgaggtccgagacctggactttgccaacgatgccaacaaagtgttggccaccacggtgaagaagctggagaacggcagcatcacccagaatgagaggaggtttgtgactaagttgttggaagaccttattttctttgtggctgatgtgaccaacaacggacaggatgttctggatgtggtcatcaccaagcccaaccgggaacggcaaaaactaatgagggaacagaatattctggcacaggtgtttgggatccttaaagcccctttcaaggagaaggctggggaaggctcgatgctgaggctggaggacctgggcgaccagcgctatgccccgtacaagtacgtgctgcgtctctgctaccgtgtgctgaggcattcgcagcaggactacaggaagaaccaggagtacattgctaagaacttctgcgtcatgcagtctcagatcggctatgatattttggcagaagatacgatcacagccttgctacacaacaaccgcaaactcctggagaaacacatcacggccaaagaaatcgagaccttcgtcagcctgctcaggaggaaccgggagccgaggtttctggactatctgtctgacctctgcgtgtccaatagcaccgccatccctgtgactcaggagctcatctgcaaattcatgctgagccccggcaatgcggacatcctcattcagacgaagctggtgtccatgcaagtggaaaaccccatggagagctccatccttcccgatgacatcgacgacgaggaggtttggctttactggattgacagcaacaaggagcctcacggcaaggccatcaggcacctggcccaggaggccagggaaggcaccaaggctgacctagaagtcctgacctattacaggtaccagctaaacctctttgcaaggatgtgcttggaccgccagtacctggccatcaaccagatttcaacacagctgtctgtagacctgatcctgcggtgcgtgtctgacgagagcctgccctttgacctccgagcctctttctgccgactcatgctccacatgcatgtggaccgggacccccaggagtctgtggtgcctgtccgctacgcccggctctggactgagatccccaccaagatcacgatccatgagtatgactccatcacagactcttccagaaatgacatgaagaggaagtttgccctgacaatggaatttgtcgaagaatatttgaaagaagttgtgaatcaaccgtttccttttggggacaaagagaaaaataaactgacatttgaggtggtccacctggcccggaacctcatctacttcggattctacagcttcagcgagttgctgcggctgacgagaactctgctggcgatcctggacatcgtccaggcccccatgtcgtcgtattttgaaagattaagcaagtttcaagatggaagcaacaatgtcatgaggaccatccacggggtgggagagatgatgacacagatggtgctcagcagaggctccattttcccagtgagctggcccgacgcacagcccagcgtccaccccagcaagcaggcgagccccggcgagcaggaggatgtgacggttatggataccaagctaaaggttatcgagattttacagttcatcctgagtgtcaggctggactaccgtatctcttacatgctgtccatatacaagaaggaatttggggagaatgatggcaacggtgacccctctgccagcggcaccccggaaacattgctaccatcagctcttgtccctgacattgatgagattgcggctcaggcagaaacgatgtttgctggaagaaaagaaaaaactccagttcagcttgatgatgagggaggcagaaccttcttaagagtcctcatccacctgatcatgcatgactatgctccactgctgtccggggccctgcagctgctgttcaaacacttcagccagagagcagaagtgcttcaggccttcaaacaggtgcagttactggtgtcgaaccaagatgtcgataactacaagcaaatcaaggcagacctggaccaacttcggctgacggtggagaagtccgagctatgggtggaaaagagcggcagctatgagaatggagacatgggcgagggccaggccaaaggaggcgaagaggcaaacgaggagtccaacctcttgagcccggtgcaggacggcgcgaagacacctcagatcgacagcaacaagggcaacaactaccggatcgtcaaggagatcttgattaggctgagtaagctctgtgtgcagaacaagaaatgtcgtaatcaacaccaacggttgctgaaaaatatgggggctcactccgtggtactggaccttctgcagatcccctatgagaagaccgacgagaagatgaacgaggtgatggacttagcccacaccttcctgcagaacttctgccgcgggaatccacagaaccaagttctccttcacaagcatctcaacctgttcctaacccctggactcctggaggcggaaaccatgcggcacatcttcatgaacaattaccatctgtgcaatgagatcagcgagagggtggtccagcactttgtgcactgcattgagacacacggccgccacgtggagtacctgaggttcctgcagaccatcgtgaaagcagacggcaaatacgtgaagaaatgccaggacatggtgatgaccgagctgatcaatgggggtgaagacgtactgatattctacaacgaccgagcctcatttcccatccttctcaacatgatgtgctccgagagagcccgtggggatgagagcggccccctggcctaccatatcacccttgtggagttgctggcagcgtgcactgaggggaagaacgtctacacggagatcaagtgcaattctctcttgcctctggacgacatagtgagggtggtgacccacgacgactgcattcctgaggtaaaaattgcatacgtgaactttgtcaaccattgttacgttgacacagaagtggagatgaaggaaatctatacaagtaaccacatttggaagttatttgagaacttcttggtggatatggcaagggtctgcaacaccaccacggaccggaaacacgcagacacctttctggagaggtgtgtgacagagtcagtcatgaacatcgtgagcggcttcttcaactcgccgttttcggataacagtaccagcctccagacccatcagccggtctttatccagctgctgcagtccgccttcagaatttacaactgcacctggcccaacccagcccagaaagcctccgtggaatcctgcatcagagccctggctgaagtggccaaaaaccgtgggattgcgattccggtggatttggacagccaggtcaacacactcttcatgaagaatcactcaagtacagtgcagagggcggccatgggctggaggctctctgctcgctccggacctcgcttcaaggaagctcttggagggccagcatgggactacaggaatattattgaaaagttacaggatgtcgtggcctctctggaacagcagttcagccccatgatgcaggctgagttctctgtgcttgtggatgtgctgtacagcccggagctactgttcccagaaggaagcgatgccaggatacgatgtggtgccttcatgtccaagctgattaatcacacaaagaaactgatggaaaaagaagaaaaactgtgcattaaaatcctccagacgttacgggagatgctggagaagaaagacagcttcatggaagagagtagcacattacggaaaatcctcctgaatcggtacttcaagggtgaccacagcgttggtgtgaacggacctctgtcaggagcctacgccaagacagcacaagtgggagggggcttcactggacaggatgccgataagacggggatttccatgtccgatatccagtgtttgctggacaaggaaggggcctccgaacttgtcatcgatgtcattgtgaacaccaaaaacgacaggattttttccgagggcatcttgcttggcattgccctgctggaaggaggaaacacacaaacccagaattctttctaccagcagttgcatgaacaaaaaaagtcagagaaattcttcaaagtcctttacgatcggatgaaggctgctcagaaagagatcagatccacggtgactgtcaacaccatagacttagggagcaagaagagagaggaggacagtgacctcatggccttgggccctcggatgagagtgagagactcatcgctgcatttgaaagagggaatgaaagggcagttgactgaggcgtcttcagccacgtccaaagcatactgtgtgtacagaagggaaatggacccagacattgacacgatgtgcccgggacaggaagcaggaagtgcggaggaaaagtctgcagaggaagttaccatgagcccagccatcactatcatgcggcccatcctcaggttcctgcagttactgtgtgagaatcacaaccgggagcttcagaacttcttgaggaaccagaacaacaaaacaaactacaaccttgtctgtgaaacacttcagtttctggactgcatctgtggaagcaccacagggggcctaggcctgctggggctctacatcaatgagaagaacgtagctctggtcaaccagaccctggagagcttgaccgagtactgccagggcccgtgtcatgagaaccagacctgtatcgccactcacgaatccaatgggattgacatcatcatcgccttgattctgagtgacatcaaccctctgggcaagtacagaatggacctggtgctacagctgaagaacaacgcctccaagcttctgctggccattatggagagcagacacgacagtgagaatgcagagagaattctcttcaacatgagacccaaggaactggtggatgtcatgaagaatgcctataaccaaggcctggaatgtaaccatggggacgaggagggaggagatgatggtgtttctccaaaagacgttggacacaacatctacatcctggcccatcagttggcccgccacaataaactcctacagcagatgctcaagcctggatccgatccagaggaaggggatgaagccttgaagtactatgccaaccacaccgcacagatcgagattgtgcggcacgaccggactatggagcagattgttttccccgtccccaatatctgcgaattcctcactcgggaatccaaataccgggtgttcaacacaacggagagggatgagcaaggaagcaaggtgaacgacttcttccagcaaacggaagatctctacaacgagatgaaatggcaaaagaagatcaggaacaaccccgccctgttctggttctccaggcacatctccctgtgggggagcatctccttcaacctggctgtgttcatcaacctggccgtggctctcttctacccattcggggatgacggcgatgaaggtacgctctccccgctgttctcagccctcctttgggtagcagtggcgatctgcacgtctatgctgttcttcttctccaagcctgtgggcatccggccattccttgtgtctatcatgctcagatcaatatacaccatcggtctggggccaacgctaatacttcttggtgctgccaatctatgcaataaaatcgtgttcctggtgagttttgtgggaaaccgaggcacattcacccgagggtaccgagcagtcattctggacatggcctttctttaccacgtggcctatgtcttggtttgcatgcttggcctcttcgtccacgagttcttctacagcttcctgctttttgacttggtgtacagagaagagaccctgctgaacgtcatcaaaagcgtcacacggaatggccgctccatcatcctgactgcggtcttggctcttatcctggtctacctgttctccatcatcggcttccttttcttaaaggatgacttcaccatggaggtggacagattgaaaaacagaactccagtcacaggtaacgacggggttcccactatgaccttaacttccatgctgggaacctgccctaaggaaaactgctcacccacgatcccctcttcgaatgcagccggtgagggaggtgaggacggcatcgagaggacctgtgacaccctgctcatgtgcattgtcaccgtgctgaaccagggcctcaggaatggtggcggagttggtgacgtgctgagacgaccctcgaaggatgagcctttgtttgctgcccgggtggtctacgacctccttttcttcttcatcgtcatcatcatcgtccttaacctgatttttggtgtaatcattgacactttcgctgacctcaggagtgagaagcagaagaaagaaaaaattctcaagacaacctgcttcatctgtggcttggagagggacaagtttgataacaagacggtgtcctttgaggagcacatcaagtcagagcacaacatgtggcattacttgtacttcatcgtcctggtgaaggtgaaggacccaacagaatacacagggcctgagagctacgtggctcagatgatcacagagaagaatttagactggtttcctcggatgcgagccatgtcacttgtcagcaatgaaggtgacagtgagcaaaatgagatccggaacctgcaggagaagctggagtccactatgagtctggtgaaacagttgtcggggcagctggcagagctgaaggagcagatgacagaacaaaggaaaaacaagcaaaggctgggcttccttggatcaaacacaccccatgagaaccatcacatgccaccgcactgacaccatgggggcacgccgtgaccagcctttcatcagatgcctgcctcatcgctgagggatggagatggaggggagcgaacagtggctattgttgaaaagctgaaaacaaccaagtgccaaggtgctgagccattcagctcccagaacaatctgtaactgtgtttgcacgcttgagaaggttcaagcttggaaaaaaacaaaacaaaacagtatagggcacagcctctccatgtggcaggaagcggccagcctgaggggctggagggggtgggagagtctgatcggggagcggcagacctccccctgctcgatcgataggccttggacttgtctcacacactgactgcagtgtccatcgtggctggttgaaattttttcttcaaactgtggcactggggtcagcgagacaggaagccacactctgctggctaagtctaagaaatttaaaagattaaaaaggagaattgaaaagggtgtcgttaaacttccgaaccttacgtgttaactggacattttcttcttggcatgagacgggctcagagcactacccctcagtgctttggagttcacaccccacccactgcaaaacataactgggatcagggtggctgtgtccagagctctgtacagggctgtgcaacagaaagctttcatagaattggctaagactgctcaaagcctggtgcctatgtgctgagatgttaaagacttggggaagagaagcttgtctgttcaggaaacaacgtttgcagtgtatatgctactaaagtatgtgggcattgaaagaaaaactcgagggtaacagcccaacactgagaagcgttactcgggtggccttgcctttaaaagcaggttaatttatatttgaggtgcttgacccaagtgcttgcgatccccgaagctgagggggttggggggaatctaagaattgcattgactacgtaagaatatgcaacatttcaacagcacatttaaggctgttagagtaacagcttttcaaaatgtaggcagatcataattccttccccctaactgttttcatgttgactcatgcaaccagattttgtcaagggaaaaaataacttggaaggagagattccttttggagactgtctgaggtgtcagagacagacagatcatgtaagtgtgagaccatctggtggtgaggggccaccagccaagacactacattctgaaacagagaccctctctggcctccagattctttaaactctcagccaccaagggccacatggggtttgttacagcaagttttaaagctttctggcatttcaatacagttttagcagttggctcctaaaaataaacaaacaaacaaacaagtcaaatcctgggtgtgtatagacccactgtacaggcagaaactcaaatggcttaccttctcttgggtgtagccttggaaccaccgagatgtactttctaactaaatgctgcacacactaggaccacccagagttacaaagtgctcttggacagggccctgctccccttagcctaaagtggaaagatgctggtgccttgacctcaggtgttctaggctaaaacactgcaccactgaccctcgactcttgtaagagacctgtcttcagttacccttaattctttgctaaagcttcaaactataatcacaaacatttttttgaagggtatcaccaaaattaggccacggcagccatttttaaagctcaggaccatggatacttcgacggtatttggtaaaagtaaaataggctgggcgatcagaaggataggagctgcttcagtctgctgtaacctaaccctccatccgttgtgccagcagcccacagttcgacaccgtggcttcctcctgtgggaactatccaaaagatttcacctaacgagactctcactatgtcaaaattaatttttttcagttgtactttttctttcccctctacaagatgaaagattataaagtgaaattttataaacatcaaccaaagcaaaggcactttctaggacactgacttcataaagatgttagaaatgaggaaatttgatgtcaggtgagagtttatacttgttatgtatggttactaatgcagcgggtgtagctgactgaagtttgatatagttgtattctcacatttatagtgatattaaaaatacagtcacctctgacttctatgccagggaaggcttttttaaattttaggttattaaaatccatattggttaaaagtcacagttcccactgaataatatttttaattcacagaagggtttgttcccaggtgtgctccattctgcatcacaagagtttagtcgaagacattttctaaattaaaataattgtttgtaattagaaaaaaaa

SEQ ID NO: 2224 - DNA, 3177 bp, Rattus norvegicus
  Genbank Accession No. NM_031047
gctgccttggccagagtccggagcagccgccgcccgagcgccccgagctcagttcgctgcctgcgccggctgtctcccggccagacccgaccccgacccggctcggcccggctccacgctcaggtacaccggatagggccacgatggaggtgatgaaccttattgaacagcccatcaaggtgacggagtggcagcagacgtacacctatgactcgggcatccactccggtgtcaatacctgtgtgccctctgtcagcagcaagggcctcctcgatgaggatgacacctgcggcagacagtacacactcaagaaaactaccacctacacacaaggggtgccacagagccaaggcgacctggagtaccagatgtccaccacggccagagccaagcgggtgcgggaggccatgtgcccaggtgtctcaggcgaggacagttctctcctcctggccacccaggtggaggggcagacgaccaacctgcagcgactggccgaaccatcccagctactcaagtcggccattgtacatctcatcaactaccaggacgacgcagagctggccacccgggctctgcctgagctcaccaagctgctcaacgatgaggacccggtagtggtcaccaaggcggctatgatcgtgaaccagctgtccaagaaggaggcatcccgccgtgccctgatgggctcgccccagctggtggcggctgtggtgcggaccatgcagaacaccagtgacctggatactgcccgctgtaccaccagcatcctgcacaacctctcccaccaccgagaggggctgcttgctatcttcaagtctggaggcatccccgccctggtccgaatgctcagttcccccgtagagtctgtcctgttctacgccatcaccacactgcacaacctgctgctctaccaggagggcgccaagatggcggtgcgtctggcagacggactgcagaagatggtgcccctacttaacaagaacaaccccaaattcctggccatcaccaccgactgcctgcagctcctggcctatggcaaccaggagagcaagctgatcatcctggccaatgggggaccccagggtcttgtgcagatcatgaggaactacagctacgagaagcttctgtggaccaccagccgggtgctcaaggtgctctccgtgtgccccagcaacaagcctgccatcgtggaggctggtgggatgcaggctctaggcaagcacttgacaagcaacagcccccgcctggtgcagaactgcctgtggactctgcgcaatctctcggatgtggccaccaagcaggagggcctggagaacgtgctgaagatcctggtcaatcagctgagcgtggatgatgtcaacgtcctcacctgtgccacgggccacctctccaacctgacctgcaacaacagcaaaaacaagacgctggtgacgcagaacagtggcgtggaggcgctcatccacgccatcctcagagccggagacaaggacgacatcacagagcccgccgtttgcgccctgccgcaccttaccagccgccaccctgaggctgagatggcccagaactctgtgcgcctcaactatggaatcccggccattgtgaaactgctcaaccagccgaaccagtggccactggtcaaggcaactatcggcctgatccggaacctggctctgtgccccgccaatcatgccccgctgcaggaggccgcggtcattccccgcctcgttcagctgctggtcaaggcccaccaggatgcccagcgacatgtagctgcgggcacccagcagccctacacggatggtgtgaggatggaggagatcgtggagggctgcaccggagccctgcacatcctcgcccgagatcccatgaaccgcatggagatcttccggctcaacaccattcccctgtttgtccagctcctgtattcctctgtggagaacatccagcgtgtggctgccggagtgctgtgcgagctggcccaggacaaggaggctgccgatgccatagacgcggagggcgcctctgcccctctcatggaactgctccactcccgcaatgaggggaccgcgacctacgctgctgctgtcctgttccgcatctccgaggacaagaacccagattaccgtaagcgagtgtctgtggaactcaccaactcgctcttcaagcatgacccagctgcctgggaggctgcccagagcatgatcccgatcaacgaaccctatgcagacgacatggatgcaacctaccgccccatgtactccagcgatgtgcctctggaccccctggatatgcacatggacatggatggcgactaccccatggacacctacagcgacggcctgagacctccctaccccgctgcagaccacatgctggcctagctggctccacctcactcagagctgtttctcacctggaaagctctccagagcagactgtgggacgagacagtacctaagccccgggagccagcctggacttcctgctgcacacgcgctccagagagttcctccgtagggattttgggatggtgtctctcccgcttttctgtcctgggctggggatccaggctcagtactttctccccctccccactatggctatgaccactaaagctttagactcggcctgtgtccctgtacagcagccctctctgctgactccagctgcctggacccccagggcttcctttgtttttccggggccagttttctcaatgaactaaagcatccaactgccctgacctcctgggatatccaagacacaggttcaaggcccaaacccttcacatccaaagcttcttttgaaaagttcagggaccttcttgggggtagcgggagagagtggagactttttaagtgcccctgctaggacctgcccttctcttcaggatgctaagtctgccttgcccctcccaagggtgaagctccctctcacactgctccacactggcccatctgacctgcagaagtgctctagctcacccctctggtgtgtggtgaggggctttcttctcccactcctttttgactcccaccacctcctgcacatgggtttggggaggactgaaatggaagtcccctcagagagtcttattatcaacactttatgttttggttattggtttttctttcctttttgtttttgtatagaccaaagcaaagaaaataaaataac

SEQ ID NO: 2225 - DNA, 1740 bp, Rattus norvegicus
  Genbank Accession No. NM_031050
cggaaacagtgtcaagagagtaagggcacagaggacttgctgaaaatgaatgtatgtacgttcactcttgtcttggcattagtcggtagtgtcagtggccaatactatgattatgatgcccctctcttcatgtatggggaactgtcacccaactgtgcaccagaatgtaactgtccccacagctacccaactgccatgtactgtgatgatctcaagttgaaaagtgtgcccatggtgccccctggcatcaagtacctttacctgaggaataaccagatcgaccatattgatgaaaaggcctttgagaatgtaacggatctgcagtggctcattcttgaccacaatcttctagaaaactccaagatcaaaggaaaggtcttctctaagctgaaacaactgaagaagctgcatataaactacaacaatttgaccgagtccgtgggtccgctcccaaagtccctacaagaccttcagctggccaataataagatcagcaagctgggctccttcgacgggctggtaaacctgaccttcatttaccttcaacacaaccagctcaaagaggaggctgtctcggcttctctgaaaggccttaagtcactcgaatacctcgacttgagcttcaatcagatgagcaagctgcccgctggccttccaacatctcttctaactctctacctagacaacaataagatcaccaacattcctgatgagtatttcaatcgcttcaccgggcttcaatacttgcgtttatctcacaatgagctggctgacagtggcgtgcctggaaactcatttaacatatcatctctgctcgagctcgatctctcctacaataagctcaagagtataccaaccgttaatgaaaaccttgaaaactattacctggaggtcaataaactcgaaaagtttgatgtcaagagcttctgtaagatcctgggaccactatcttactccaagatcaagcatttgcgcttggatggcaatcccctcactcaaagcagtctgccccctgacatgtacgagtgtctacgtgtagcaaatgaaatcacggttaattaacctcctctcattctaatacattgaagtatgttccagagcagtacttcatggatgggtatttgctggatgtgttaaagttttcacaatatcctttacattgttattgtcattgttgttgttggtattacttcatggattttaattaataaaggaaatgttttgtgaacatttaccactttttaaataaaagatgaaaagcaggcctatttcatcgtgagaacagacacataaaacccgttaaacttaagtctatttgtgaatttaatgttttctatagctctatgttcaggtgattatgaagcctttttactgattgcttggaagtccaccaggtttctatggttcctcacattttacattagtgacttcgaaaacatgaaacaaacatgcatggatgtttgttatcctaatccaaatttttgtgacatgtcaagtttgttttacagaagtttagatcctatgttttgaaaccagtgatttgcaacataccaaagaaaattactaaagacctgtctacttaaagaaatgtagttagcagtaagaatttcccagttacttaatgaaacttttcttgagtcattttcctgtcatatctatgtttctttctgattgtttgcatgttatgattaacaagctgatagcaaaataaaacaatgcaaatggtaaaaaaaaaaaaaa

SEQ ID NO: 2226 - DNA, 3231 bp, Rattus norvegicus
  Genbank Accession No. NM_031054
cgggtggaccccagggcactgccacgacctcagggtgacacgcggagcccgggagcgcaaggatggaggcacgattggtctggggagtgctcgtcggacctctcagggttctctgcgtcctgtgctgcctgctgggccaggtggaccccagggcactgccacgacctcagggtgacacgcggagcccgggagcgcaaggatggaggcacgattggtctggggagtgctcgtcggacctctcagggttctctgcgtcctgtgctgcctgctgggcgggtggaccccagggcactgccacgacctcagggtgacacagcgagcccgggagcgcaaggatgggaggcacgattggtctggggagtgctcgtcggacctctcagggttctctgcgtcctgtgctgcctgcttgggcgggtggaccccagggcactgccacgacctcagggtgacacgcggagcccgggagcgcaaggatggaggcacgattggtctggggagtgctcgtcggacctctcagggttctctgcgtcctgtgctgcctgctgggccacgccatcgctgcaccatcgcccatcatcaagttccccggcgatgtcgcccctaaaacagacaaagagttggcagtgcaatacctgaatactttctatggctgccccaaggagagttgcaacctctttgtgctgaaagataccctcaagaagatgcagaagttctttgggctgccccagacaggtgaccttgaccagaacaccatcgagaccatgcggaagccaagatgtggcaacccagatgtggccaactacaacttcttcccccgcaagcccaagtgggacaagaaccagatcacatacaggatcattggttacacacctgacctggaccctgaaaccgtggatgatgcttttgctcgggccttaaaagtatggagcgacgtcactccgctgcgcttttctcgaatccatgatggggaggctgacatcatgatcaactttggacgctgggagcatggagatggatacccgtttgatggcaaggatggactcctggcacatgcctttgccccgggcactggtgttgggggagattctcactttgatgatgatgagctgtggaccctgggagaaggacaagtggtccgcgtaaagtatgggaacgctgatggcgagtactgcaagttccccttcctgttcaacggtcgggaatacagcagctgtacagacactggtcgcagtgatggcttcctctggtgctccactacatacaactttgagaaggatggcaagtatggcttctgcccccatgaagccttgtttaccatgggtggcaatgctgatggacagccctgcaagtttccgttccgcttccagggcacctcctacaacagctgtaccaccgagggccgcaccgacggctaccgctggtgtggcaccaccgaggactatgaccgggataagaaatatggattctgccccgagaccgctatgtccactgtgggtggaaattcagaaggtgccccatgtgtcttccccttcactttcctgggcaacaagtatgagagctgcaccagcgccggccgcaacgatggcaaggtgtggtgtgcaaccacaaccaactacgatgatgaccggaagtggggcttctgtcctgaccaaggatatagcctattcctcgtggcagcccatgagttcggccatgccatggggctggaacactctcaggaccctggagctctgatggcccctatctacacctacaccaagaacttccgattatcccatgatgacatcaaggggatccaggagctctatgggccctcccctgatgctgatactgacactggtactggccccacaccgacattgggacctgtcactccggagatctgcaaacaggacattgtctttgatggcatcgctcagatccgtggtgagatcttcttcttcaaggaccggtttatttggcggacagtgacaccacgtgacaagcccacaggtcccttgctggtggccacattctggcctgagctcccagaaaagattgacgctgtgtatgaggccccacaggaggagaaggctgtgttcttcgcagggaatgagtactgggtctattctgccagcactctggagcgaggataccccaagccactgaccagcctggggttgccccctgatgtccagcaagtagatgctgcctttaactggagtaagaacaagaagacatacatctttgcaggagacaagttctggagatacaatgaagtgaagaagaaaatggacccgggtttccctaagctcatcgcagactcctggaatgccatccctgataacctggatgctgtcgtggacctgcagggcggtggtcatagctacttcttcaagggtgcttattacctgaagctggagaaccaaagtctcaagagcgtgaagtttggaagcatcaaatcagactggctgggctgctgagctggccctgttcccacgggccctatcatcttcatcgctgcacaccaggtgaaggatgtgaagcagcctggcggctctgtcctcctctgtagttaaccagccttctccttcacctggtgacttcagatttaagagggtggcttctttttgtgcccaaagaaaggtgctgactgtaccctcctgggtgctgcttctccttcctgcccaccctaggggatgcttggatatgtgcaatgcagccctactctgggctgccctggtgctccactcttctggttcttcaacatctatgaccttttattggcttcagcactctcagagttaatagagactggcttaggagggcactggtggccctgttaacagcctggcatggggcagtggggtacaggtgtgccaaggtggaaatcagagacacctggtttcaccctttctgatgcccagatacctgcaccaccttaactgttgctttgtatgccccttcgctcgtttccttcaaccttttcagttttccactccactgcatttcctgcccaaaggactcgggttgtctgacatcgctgcatgatgcatctcagcccgcctagtgatggttcccctcctcactctgtgcagtcatgcccagtcacttcctccactggatggaggagaaccaagtcagtggcgtggaaaactgaaaaggttgaaggaaacgagcgaagggcatacaaaagcaacagttaaggtggtgcaggtatctgggcagcagaaagggtgaaaccaggtggca

SEQ ID NO: 2227 - DNA, 710 bp, Rattus norvegicus
  Genbank Accession No. NM_031065
cttttccggttcccgcagccgcagccatgagcagcaaagtttcacgcgacaccctctacgaggcggtgcgggaagtcctgcacgggaaccagcgtaagcgccgcaagtttctggagacggtggagctgcagatcagcctgaagaactacgaccctcagaaggacaaacgcttctcgggcaccgtcaggcttaagtccacccctcgccccaagttctccgtgtgcgtcctgggggaccagcagcactgtgatgaagccaaggccgtggatatcccccacatggacatcgaggcgctcaagaagcttaacaagaacaagaagttggtcaaaaagctggccaagaagtatgatgcctttttggcctccgagtctctgatcaagcaaatcccacgtatcctgggcccaggcctaaacaaggcgggcaagttcccctccctgctgacacacaatgaaaacatggtggccaaagtggatgaggtgaaatccacaatcaagttccagatgaagaaggtgctgtgtctggccgttgccgtcggccacgtgaagatgaccgatgacgagctagtctacaacatccacctggctgtcaacttcttggtgtccttactcaagaaaaactggcagaacgtccgggctctgtacatcaagagcaccatgggcaagccccagcgtctgtattaggacgctccaataaacctcgttgctgccttc

SEQ ID NO: 2228 - DNA, 3111 bp, Rattus norvegicus
  Genbank Accession No. NM_031077
gttggccaccatggggatgtaccaagtgagactgtagggaaagaaggtggtgactcgcgtgcctggctactggctgctgctcacctcgatgctacaagattcctagcaagatcaaaactgaccattaacctacctctacatccccctggcgccgttccagggccaacgccacattccctgctgggcacgcaatggccgcaccccctcccgctacagaaggctcttttggtacacgcagtccgaggtcgccatggatcggatgaagaagatcaaacggcagctgtcaatgacactccgagggggccgaggcatagacaagaccaatggtgtccctgagcagataggcctagatgagagtggtggtggtggtggcatgacccttggagaagctcccacccgtgttgcccctggggaacttcgctctattcggggcccactcagctctgcaccaggtctacctgggtttcccagtctgctctaggggccatgtacacaaatggatacgatgaagaaatatattatattgggggaaagagagtgttcttgactccaaaggcctggcctttccctcactctgcaccagagattgtgcatgaagacatgaagatgggatctgatggggagagtgaccaggcttcagccacatcctcagatgaggtgcagtctccagtgagagtgcgcatgcgcaaccaccccccacgcaagatctccactgaggatatcaacaaatgcctgtcactaccagctgacatacggctgcctgagggctaccttgagaagctgaccctcaatagccccatcggtgataagcctcttagccggcgcctccggccagtcagcttgtctgagattggctttggaaaactggagacctacatcaaactagacaagctgggtgagggtacctatgccactgtctacaaaggcaaaagcaagctcacagacaaccttgtagcacttaaggagatcagactggaacacgaagaaggggcaccctgcactgctatccgggaagtatccctgcttaaggacctcaagcatgccaacatcgtcacactacatgacattatccacacagagaagtccctcacccttgtctttgaatacttggacaaggacctgaagcagtacctggatgactgtggaaatgtcatcaacatgcacaatgtgaaactgttcctgttccagttgctccgtggcctggcctactgccacaggcagaaggtgctacaccgagacctcaagccccagaacctactcatcaacgagaggggagagctcaaactggcagactttggcctggcttacgccaagtcaattcctactaaaacatactccaacgaagtggtgacactgtggtaccggccccctgacatcttacttgggtccacagactactccggccaaattgacatgtggggtgttggctgcatcttttatgagatggccacaggccggcccctcttcccaggctccacagtggaagaacagctgcacttcatcttccgcattttgggaaccccaactgaggacacatggccaggtatcctgtccaatgaagagtttagaacatacaactaccccaagtaccgagccgaggcccttctgaggcatgcaccccgacttgaatgcgatggagctgacctcctcaccaagctgctgcagtttgagggtcgcaatcggatctctgctgaggatgccatgaaacatccattctttctcagcttgggggagcggatccacaaacttcctgacactacttccatatttgcactaaaggaggtacagctacaaaaggaggccaacattcggtccacttctatgcctgactcaggcaggccagctttccgtgtggtggataccgagttctaagccaagttttaagccacagacagaccaaggccccagcaggcagcggctggagggatgccacacccctcacaggacagcccccatctgcaatcctccctgcttgttgcctgcttacctgcctgagccacactcccctgccaacttgtcccctgccacctgtccaaacaccgaactactggcctggcctgtcaacccaaccactggcctgtctgctgggtgctaacaaagctctcaccactactttgcttgatgtgtctgtctctgtcttggtagatgctggtggaccgaatggccgtgccagctttccacactaaggctaggccttcccctcttcatcacactctctcccaggaccactaccccatggccagccaggggtttggagctagcccaggccaggctcttaatcgactttgactagaaggtagtgagtgatgccttgggtctgagcatcatttgcctgcttcccacctgtcccacttgcctctgttgtatgggcttttttttagtttcttttattgtttttttattattttaaatgaggttctcactttttaatgcaatatctctgtatacagactggttgggcactactccctgagtgtggcactcccacagtattttgtgcaatgaagtcccactcccaccctttgagaggtagggacccagaccctattcagatcctcaccatcactagaccctggaattggctatgggaaagcatgcctcagccactcaccttcctcccctacctagcgttcccagctatagggggacctgagaactaccagagagtgggagatggacatggtggggcctactttttccctccttcagtcccgtagccagggcctccttccttctcagggtcttccccagcccagctctgcctagccctcctgccctgtcctactcggtgctgttgagtaggggctctgcctggaatcgagcagcttagtgaggagccatatataatatgtgcacaagcaggaggacatgtgggagcttgtgcccaattgttacaccccaatccctaggagggtcaggcaggccaaggacagtctcctggatggatggtttgctccccttactccaccttaagccttgggacccttaagcagggtgggagggcaagggagggtgccctcctagtggggtttggggggattgggttcctgaatgcaccataatcgctgtatgaaatattaaaaaaaagtctaaagtgaaaaaaaaaaaaaa

SEQ ID NO: 2229 - DNA, 3980 bp, Rattus norvegicus
  Genbank Accession No. NM_031079
cgggccgggctggaggggcgggcgggcggctacgagcatggtcctggtgttgcaccacatcctcatcgctgttgtccaattcctcaggcggggccagcaggtcttcctcaagccggacgaaccgccgccgcagccatgcgccgacagcctgcaggatgctttgctgagcctgggcgccgttatcgacatcgcgggccttcgacaggctgccaaggatgccctctcggccgtgctccccaaagtggagactgtctacacctacctggtagatggggagtccaggctggtgtgtgaggacccccctcatgagctgccacaggaaggaaaaattcgagaggctgtgatttctcggaagcggctgagctgcgatgggctgggaccttcagacctactaggaaagcccttggccaggctggtggctccactggcccctgacacgcaagtgctggtcatacccctgctggacaaggagactggaactgtggcagccgtcatcttggtgcactgtggccagctgagtgacagtgaggagcagagcctgcaggtggtggagaagcatgctctggtggccctgcagagggtgcaggccctgcagcagcgcaggcctgaagctgttcagaacacctcagcggatccctctgaagatcaaaaggatgagaagggatacaccgcccatgaccgaaagatcctgcaactgtgtggagaactctatgacttggatgccacttctctgcagctcaaagtccttcgatatcttcagcaggagacacaggccactcactgctgcctcctgctggtgtcagaggacaacctgcagctttcctgcaaggtcattggagagaaagtgctgggagaagaggtcagctttccattgaccatgggacgcctgggccaggtggtggaggacaaacagtgtatccagttgaaggacctaacctctgacgatgtgcaacagctacaaaacatgttgggctgtgagcttcgggctatgctatgtgtccctgtcatcagtcgagccactgaccaggtggtggccctggcttgcgccttcaacaagcttggaggagacttcttcacagatgaggatgaacgtgcgatccaacactgcttccactacacaggcacggtgctcaccagtaccttggccttccagaaggagcagaagctcaagtgtgagtgccaggctcttctccaagtggcaaagaacctcttcacccacctggatgacgtctctgtcctgctacaggagatcatcacagaggccagaaacctcagcaacgcagagatctgctccgtgttcctgctggatcagaatgagctggttgccaaggtgttcgatggcggtgtagtggacgatgagagttatgagatccgcatccctgcggaccaaggcatcgcgggccacgtggcgaccacgggccagatcctgaacatcccagatgcatacgcccatccgcttttctatcgcggcgtagacgacagcactggcttccgcacgcgcaacattctctgcttccctatcaagaacgagaaccaagaggtcatcggtgtggctgagctagtgaacaagatcaatgggccatggttcagcaaatttgatgaggacctggccacagccttctccatctactgtggcattagcatcgctcactctctcctatacaaaaaggtgaatgaagcccagtaccgcagccacctggccaacgagatgatgatgtaccatatgaaggtctctgacgatgaatacaccaaacttctccatgatggcatccaacctgtggccgccattgactccaactttgccaacttcacctatactcctcggtctctgcctgaggacgatacttctatggccatcctgagcatgctgcaagacatgaacttcatcaataactacaaaattgactgcccaactctggcccggttctgcctgatggtgaagaaaggctaccgggatccgccctaccacaactggatgcacgccttctctgtctctcacttttgctacttgctctacaagaatctggagctctccaactacctcgaggacatcgagatctttgcgttgtttatttcctgcatgtgtcacgacctggaccacagaggcacaaacaactccttccaggtggcctcgaaatctgtgctggctgcactctacagctcagagggctctgtcatggagaggcaccactttgctcaggccattgctatcctcaacacccatggctgtaatatctttgaccacttctctcggaaggactatcagcgaatgctggacctgatgagggacatcatcttggccacggacctggcacaccacctccgcatcttcaaggacctgcagaagatggctgaagtgggttatgaccgaaacaacaagcaacaccacaggcttcttctatgcctccttatgacctcctgtgacctctctgaccagacaaagggctggaagaccaccagaaagattgcggagctgatctacaaagagttcttctcccaaggagacttggagaaggccatgggcaaccgaccaatggagatgatggatcgggagaaggcctacatccctgaacttcagatcagctttatggagcacatcgccatgcccatctacaagctgttacaagacctgttccccaaggcagcagagctgtatgaacgcgtggcctccaatcgtgagcactggaccaaggtgtcccacaagttcaccatccgaggcctccccagtaacaactcgctggatttcctggatgaggaatatgaggtccctgatttggacgtcaccagggctcctgtcaatggctgctgcagcctcgagggctgagtgatcccctctagggaccctccctgcccggccctcctttcacaactctctaccagtctgtctgatgcattgggaaccagagccatgggtcctgggttctagaccaggatgtcccctgtgacctggcacatgccacccttcctgggcttcgtctttctcatctgcagaaggaattcgagattcgcagtctcacacagacttggccgtttgttcttcaagagcacagtagtgaccagtggcagtgggcttccttctgcacctctgactgtaccgtgcccagttctgcccaagccactccatctttgagccacagaaccttctgtgaacccattagagccccattacgtcagtatccttgttttcctggaggaatcccaggtctctggagacttcgagatcctcatggaagaaggagaggccaccgagagagcagagggtataaatcagtcaccagctagaagtcgccatagggtgaagggaccctgagggtgcctctgtgcttctggcaggactgggaccctggaggaagctgacagccaggttgctcagtgctctgcaggaggcagtgctccagcagagaaggcaggaataagggacagaaggatcctcaagctgggagacagtccctacacacccctgcccttcaggtgttgtgacctgaagtgagttcctttccctagctagccaagacaggatcattagacagcctattctctctttagatcaaagtctccgtcattctgtggagtccgtgagtggttgtggcatgctctgccaccctgaggcacagagagcctaacctcctttcctctgagtgtatccccctggtctgagcccctctcccattcctgccatcagagaggggcctggcctctctccacagggcttctctcctcttcaaggccatatccacacctgccccccggagggctcaggagactctcccagggctgggcctcttgggtgagtggccactagcttctccttctgttttgttctgtatgtattgtgggtgggggagggggccacctgccttacctactctgagttgcctttagagagatgcatttttctaggactctgtgcacctgttgttgtatgtagtcctgtgggctgagtgctttgtacatgagaataaatctatttctttctacca

SEQ ID NO: 2230 - DNA, 3205 bp, Rattus norvegicus
  Genbank Accession No. NM_031083
ttactatggcatcggtagtgtcctgacagttcggaaagcaggaaagcaagcgccgagaagaaaggctcgggcccagcggactcttacatcgcaacccatcaaggaattgttattttgggtcctgcaagtggggtccggtccaacttgaggtagcgtgaaggccccttcaggcggcgccgcgggcagccccgcagccggggcctggtgcagccgccgcggccgctgtcagggaagcgcaggcggccaatggaacccgggagcggccgctgctgctgaggcggcggtgtcggcagtccgaccccgaccgcctgcaccccctccgcgagggtcccccggagcttggaagctcgaagtctggctgtagccatgggagacatggtagtggagcctgccaccctgaagccaacttctgagcctactcctagcccatcagggaataacgggggctccctactaagcgtcatcacggagggggtcggggaactgtcagtgattgaccctgaggtggcccagaaggcctgccaggaggtactggagaaagtcaagcttttgcatggaggtgtagccatctctagcaaaggcagcccactggagttggttaatggggatggtgtggacaatgagatccgttgcctagatgatccacctaccgagatcagggaggaagaagatgagatggagcctggtgtggtctctggcacagccaaaggaacaagaagaagacgacagaacaactcagccaaacagtcttggctcctgaggctgtttgaatcaaaactatttgacatctctatggccatttcatacttgtataactccaaggagccgggagtgcaagcctacattggcaaccggctcttctgctttcgcaatgaggatgtggacttctatttgccccagttgcttaacatgtatatccatatggatgaggatgtgggtgatgccattaaaccctacatagtccaccgttgtcgccagagcatcaacttttccctccagtgtgccctgttgcttggggcctactcttcagacatgcacatttccactcaacgacactcccgagggaccaagttacggaagctaatcctctcagatgagctgaagccagctcaccgaaagagggagctgccaactttaagcccagcccctgacacaggactgtctccctctaaaaggactcaccagcgctctaagtcagatgccacggccagcataagtctcagcagcaacctgaaacgaacagccagcaaccctaaagtggagaatgaggatgaggagctctcctccagcaccgagagtattgataattcattcagttcccctgtccggctggcccctgagcgagaattcatcaagtccttgatggcaatcggcaaacggctggccacgctccccactaaagagcaaaaaacacaaaggctgatctcagaactttccctgctcaaccataagctccctgcccgagtctggctgcccacagctggctttgaccaccacgtggtccgtgtgccccacacacaagctgttgtcctcaattccaaggataaggctccctacctgatctatgtggaagttcttgaatgtgaaaacttcgacacaactaatgttcctgcccggattcctgaaaaccgaattcggagtacgaggtctgtggagaacctgccggaatgtggtatcactcacgagcagcgggctggcagcttcagcactgtgcccaattatgacaatgacgatgaagcctggtcggtggatgacataggcgagctgcaggtggagctcccagaagtgcacaccaacagctgtgacaacatctctcagttctcggtggacagcatcaccagccaggagagcaaggagcctgtgttcattgcggcaggggacatcagacggcgcctttcagaacagctggctcacactcccacagccttcaaacgagaccctgaagacccttctgcagtcgccctcaaagagccctggcaggagaaagtgcggaggatcagagaaggttccccgtatggccatcttcccaattggcgactcctttcagtcattgtcaagtgtggagatgaccttcgccaggagctgctggctttccaggtgttgaaacaactgcagtccatttgggaacaggagcgagtgcctctttggatcaagccatataagattcttgtgatttcagctgacagtggcatgattgaaccagtagtcaacgctgtgtccatccaccaggtgaagaaacagtcacagctctccttgctcgattacttcctgcaggagcatggcagttacaccactgaggcattcctcagtgcccagcgcaattttgtgcaaagttgtgctggctactgcttggtctgctacctattacaagtcaaggacaggcacaatgggaacatccttctggacgcagaaggtcacatcatccacatcgactttggcttcatcctttccagctcaccccgaaacctgggcttcgagacgtcagcctttaagctgaccacagaatttgtggatgtaatgggcggcctgaacggtgatatgttcaactactataagatgctcatgctgcaagggctgatcgctgctcgcaaacacatggacaaggtggtacagattgtggagatcatgcagcaaggttctcagcttccttgcttccatggctccagcaccattcgcaacctcaaagagaggttccacatgagcatgactgaggagcagctgcagctgctggtggagcagatggtggacggcagcatgaggtccatcaccaccaaactctacgatggcttccagtacctcaccaatggcatcatgtgacaccactttcaggcccagaagtggtgggattgaaggcaccctccttaggaggacccttgcctaagaaaacctaaatcacaaaatcccacctacctaaccacctacccaagggaaatggaaggcaaaaaacacaaaggatcatgtggtaaccatgagagctggccaaagggtaggagagccaaccatggggtccagacttgctggggcttccccacctcttgctgtgtcagtattgccacctgacagatcccaggactcactgccctccagagaacagagatgatgaacatgaggaggactggaaccttcttcccctcggggatctcatcttttactatccctgggtcccagcaagatgggaggagtgggttcttggtacttaggactt

SEQ ID NO: 2231 - DNA, 660 bp, Rattus norvegicus
  Genbank Accession No. NM_031091
atggcctcagtaactgatggtaacactggaatcagagatgcctctgaccagaactttgactacatgttcaaactgctcatcattggcaacagcagcgtcgggaagacctccttccttttccgctatgctgatgacaccttcacccctgcctttgtcagcactgtgggtatcgacttcaaagtgaagacagtttaccgtcatgagaagcgtgtgaagctgcagatatgggacacggcagggcaagagcggtaccggaccatcaccacagcctactaccgcggggccatgggcttcattctcatgtatgacatcaccaacgaggagtccttcaacgctgtccaggactgggctactcagatcaagacctactcctgggacaacgcacaggtcattctcgtggggaataaatgtgatatggaagaggaaagggtgatcccgactgagaagggccggctcctagcagagcaacttgggtttgacttctttgaagccagtgccaaggagaacatcagtgtgaggcaggccttcgagcgtctggtggacgccatctgcgataagatgtctgactcaatggacacagacccctccgtgctgggcgcctccaagaccacacggctctcggacaccccgccgctgctccagcagaactgctcttgctag

SEQ ID NO: 2232 - DNA, 952 bp, Rattus norvegicus
  Genbank Accession No. NM_031093
cggccaggttgacagttgggcagaagctcttggttcctcttcaagtggtaatgccttcatgccaactttgccgaagtaacctggatgatatttgtcaaagttgatcctgtggtgatgcatgcctccagcattcccgcggcctcctgggtgcttgcggtgcttaccgatgcgaccgtggccgtggctcacgtggccccggagtttccgtcttcctaccagtctggatggcatggcggtgcagattcttttcagtcctctgaagactgcacacaggatggctgcaaacaagcccaagggtcagaattctttggccttacacaaagtcatcatggtgggcagtggtggtgtgggcaagtctgctctgactctgcagttcatgtatgatgagtttgtagaagactatgaacctaccaaagcagacagctacaggaagaaggtagtgctggatggggaggaagtgcagatcgacatcttagatacagcagggcaggaagactacgctgcaattagagacaactacttccgaagtggggaaggattcctctgtgtcttctctatcacagagatggagtcctttgcagctacagcggacttcagggaacagattttaagagtaaaagaagatgagaatgtcccatttctcctggttggtaacaaatcagatttagaagataaaaggcaggtttctgtagaagaggcaaaaaacagagctgaccagtggaacgttaactatgtggagacgtctgctaaaacgcgcgccaacgttgacaaggtattttttgatttaatgagggaaatacgagccagaaagatggaagacagcaaagaaaaaaatggaaaaaagaagaggaaaagtttagccaagagaatcagagaaagatgctgcattttataatcaaagcccaaactcctttcttatcctgacctgaccatactaataaatataatttat

SEQ ID NO: 2233 - DNA, 4861 bp, Rattus norvegicus
  Genbank Accession No. NM_031094
gcggtttgaatggctgtgggcccgggccctaagctcatctgaagagccgcggcctccgggtgtgccatggcatctggaggcaaccagtcgtcacctcctcctcctgctgctgcagccagctcagaggaagaggaggaggatggcgacaccgcggaccgggcgcagcccgcagggtccccaagccatcagatccaacagcggttcgaagagctgtgcagccgccttaacatggacgaggcggcacgggccgaggcctggagcagctaccgcagcatgagcgagagctacacgctggagggaaatgatctccattggttagcatgtgccttatatgtggcttgcagaaaatctgttcctactgtgagcaaagggactgctgaaggaaactatgtgtctttaactagaatccttcgatgttctgagcaaagcctaattgaattttttaacaagatgaagaagtgggaagatatggcaaatttacccccacacttccgagaacgaaccgaaagattagaaagaaacttcactgtctccgctgtgatctttaagaaatatgaacccatttttcaagacatttttaaatatccccaagaagaacaacctcgccagcaaagaggaagaaagcagaggcgacagccctgtaccacatctgaaattttccatttttgttgggtgctttttatatacgcaaaaggaaacttccccatgatcagtgatgatctggtcaattcctaccatcttctgctgtgtgcactagatttagtttatggaaatgccctacaatgctctaaccggaaagaacttgtgaaccctaattttaaaggcgtgtccgaggacggccaccccagggactctcacccgtcctctgatccaccgtgtgtcattgagaagctctgctccttacacgacggcctagtgctggaggcaaaggggataaagcagcatttctggaaaccctacattaggaagctttttgaaaagaagctcctcagggggaaggaagaaaatctcactggcttcctggagcccgggaacttcgcagagagctttaaggctgttaataaggcgtatgaagaatacgtgttagccactgggagtctggatgagcggatatttcttggcgaggatgcggaggaggaagttggaactttctcacggtgtgtaagtgctgcctcgggcacagagagtgccgaacgaacgcagatgagagacatcttgcagcagcatcttgacaagtctaaaacacttagagtctgcaacccactgactggcgtgcggtatgttcaggagaacagcccttgtgtgactcccgtctccacagcaacacacagcctgaaccgtcttcacaccatgctggccggcctcaggaatgcacccagtgagaagctagaacagatactcaggtcatgttcccgagatccgactcgggctatcgctgacaggttgagagagatgtatgaaatatattctcagcatttccagccagacgagaatgttagtaattgtgctaaagaaatggccaacaaacactttcgttttgcagaaatgctttactataaagtattagagtctgttattgagcaagaacagaagagattgggagacatggacttatctggtgttctggagcaagatgcattccataagtcactcctggcctgctgccttgaggtggtcgctttttcctataagcctcctggaaatttcccatttattgctgaaatatttgatgtaccacattatcatttttataaggtaatagaagtatttattagagcagaagacggtctttgcagagaagtggtcaaacacctcaatcagattgaagaacaaattttagaccacttggcatggaaaaccaagtccccactgtgggatagaattagagataatgaaaacagagtccctacatgtgaagaggttacaccacctcacaacctagagagaacagatgaaatctatattgctggctctcccttaactccgagaagggtgggtgaagttcgcactgatgctggaggacttggaagaagtgtgacatctccaaccacactgtatgacaggtacagttccccaacagtcagtactactagaaggcggctatttgagagtgacagtccctctgaaggaagcacggctgggcgcatccccccacaacccctagtcaatgctgtccctgtgcagaatgtatctggggagactgtttctgtcacaccagttcctggacagaccttggtcaccatggcaacagccactgtcacagccaacaatggacaaacagtgaccattccagtacaaggtattgccaacgaaaatggagggataacattcttcccagtccaagtgaatgttgggggccaggcacaggctgtgactggctctatccagcccctcagtgctcaagcgctggctggaagtctgagttcccaacaggtgacaggaacaactttgcaagtccccggtccggtggccattcaacaaatttcccctggaggacaacagcagaaccaaggccagccgttaaccagcagcagtatcaggcctcggaagactagctccttatcacttttctttagaaaggtttactacttagctggtgtccgccttcgagacctttgtacaaaactagatatttcagatgaactgaggaaaaaaatttggacctgctttgaattctctatagtccagtgtcctgaacttatgatggacagacatctggaccagttgttaatgtgtgccatttacgtgatggcaaaggtcacaaaagaagacaagtccttccagaatatcatgcgctgttacaggactcagccacaggcccggagccaggtatacagaagtgtcttgataaaagggaaaagaagaaattctggcagctgtgagaacagaagccatcagaattctccaacagaactaaatacagacagagccagtagagactccagtccagttatgaggtcaaacagcaccttaccagttccacagcccagcagtgcccctcctacaccaactcgactcacaggtgccaacagtgacattgaagaggaggaaagaggagacctcattcagttctacaacaacatctacaggaaacaaatccaaacgtttgccatgaagtactcacaggcaaactcccaaatggacacccctcccctgtctccctatccgtttgtaagaacgggctcccctcgccgagtacagttatctcaaagtcaccctatctacatttccccacataaaaacgaagcaatgctttctcctcgagagaagattttttactacttcagcaacagcccatcaaagagactgagagaaattaacagtatgatacggacaggagagactccaactaaaaagagagggattctcttggacgatggaagtgaatcgcctgcaaaaagaatttgcccagaaaatcattctgctctgttacgtcgtctccaagatgtagctaatgaccgaggttcacactgaggttagtgtccaggaggaaactatcttcacatgaactctttggcaggacttaatgcatgcagaattatggaaccttgctccgtaatccagcaactgattagaggcgggtataaaggggagcacctctgactcagtgtggcagtaaacgcctgctatctcatcacccaaggggtggaggggtaagaggaccaggagtttaaggccaacctgacttacagagcatgtctgaggccaacttggactacatgtaacccttactcaaaacaaaaaatggaagggacattttggtaagaaagaagacttattccatgtccttagagtattttattcatcccacttgcctctacctctacttagtgcttgccttcaacactgctcagaatccacacatgaattttttttttaactctgatagacttttacaatcactgcagaaagcaaatctttagaggcctttataggtcgagccagtagaggaactgtatttaaagtcattcccgcttggcatgtggctaggtccaaccatgtgctttaggatgaaaacacccgagaagtttacaatcagaacacaggatggccaacctggaagtgtccgggcactggcctaaggctcctatgcctttgagcattatcctgtcccaaggaggtgcggacagtgtgaaagccgtgcatgtctgagtgaacctgtgtacttggtggcactttagagctgtgagatgcatagcattgtgacccagattttgctgtatatttatggtggcactttctacagtgtgaactttagccagtacaagccttctaggcttagattaaacagctaatcttttctttcatgcttttctaaaggactgctgatgtagctacacgttctgggcacgtgtaggaccctcccatttatggtagtggcattacatagggatcatttagctaaataaagatttttaaatcaagttgaattgataagtatttgaaaaattatgaccccttcctttcggaagtagctatccagaagaaagtatctttgagggtactcctggcagttaaaagaataggttggagaatttaggtttttattagtacatggtaccattgacacaaattagaagatttaatagctattgattatctacacatatctttattaatcattattatcaagtaattttttaagttggattaataatcctaaggagaaaattcaatttaaattggatcactgtaaacaaagttactaggtgacttcataccgctccaaagacccagctgacaacctacagcctggcactggccaccagagtgctgtgcaaagtacgtagaaacctcttcgtaccgctactgtaattttatatgaaaatatgtgtatttttcaataaagcacttataaatt

SEQ ID NO: 2234 - DNA, 2208 bp, Rattus norvegicus
  Genbank Accession No. NM_031097
ctctaagagccatggagagcagcggacccagcagctgccacagcgcggcccggcggccacttcactcggcacaagccgtggacgtggcctcggcctccagtttccgcgccttcgagatcctgcacctgcacctggacctgcgggccgagttgcctccgggcccgggtccggggagccgcggactgaacggcaaggcgacgctggaactgcgctgcttgctgccggagggcgcctcggagctgcggctcgattcgcacagttgcctggaggtgatggcggcgaccctgctgcgggggcagcccggagaccagcagcagctcacggagcccgtgcctttccacacacagcccttctcgcactatggccaggccctgtgcgtggtctttccgaagccctgctgtgccgccgagcgcttccggctggagctcacctaccgcgtcggagagggaccaggggtttgctggttagctcctgagcagacagcaggaaagaagaaaccctttgtgtatacccagggtcaggcagtcttaaaccgagcctttttcccttgcttcgacaccccagccgtgaaatgcacgtattcggctcttgttgaggttccagatggcttcacagctgtgatgagtgcaagcacatgggagaggagaggaccaaataagttcttcttccagatgagccagcccatcccctcctatctgatagctttggccattggagatctggcttcagctgaggttggacccaggagccgggtgacagagccctgcctgattgaagccgccaaggaggaatacaatggggtcatagaagaatttctggcaacaggagagaagcttttcggaccctatgtttggggaagatatgatttactctttatgccaccatctttcccgtttggaggaatggagaatccctgcctgacctttgtcaccccgtgcctgctagcaggggaccgatccttagccgacgtcatcatccacgagatctcccacagttggtttgggaacctggtcaccaatgccaactggggggaattctggctcaatgaaggcttcaccatgtatgcccagaggaggatctccaccatcctgttcggagctgcttacacttgcttggaggccgcaacggggagggctctgctacggcagcacatggatgtgtctggagaggaaaacccactcaacaagcttcgggtgaagattgaaccaggtgttgacccagatgacacctacaatgaaaccccctacgagaaaggttactgctttgtctcatacctggcccatctggtgggtgatcaggaacagtttgacaagtttctcaaggcctatgtagatgagtttaagttccaaagtatcttggctgaagactttctggaattctacctggagtatttccctgagctgaagaagaagggagtggattccatcccaggttttgagttcaaccgatggctgaacacccctggctggcccccctacctccccgacctctcccctggggactcactcatgaagccagctgaagagctggcggagctgtgggcagcctcagagccagacatgcaagccatcgaggctgtggccatctctacctggaagacctaccagcttgtctacttcctagataagatcctgcagaagtctcctctccctcctgggaacgtgaaaaaacttggggagacatacccaaagatttccaatgctcagaatgctgagttacggctaagatggggccaaatcatccttaagaatgaccaccaagaagagttctggaaagtgaaggacttcctgcagagtcagggaaagcagaagtacactctgccactgtaccatgccatgatgggtggcagcgagatggcccggaccctcgccaaggagaccttttcagccaccgcttcccagctccacagtaacgtggtcaactatgtccagcagatcctggcgcccaagggcagttagaggctcacctgggtggtccctgcctttctgaagaattgttccttcccaaattcatgttctcaagtcagcgtcccggagtttctgttctctgggtttgggtctctgccgtggtggcagcttctggtctagagagtcctgagagtcctaaaagggcctcccatgctccccttagaccaggctgcagagcataaaatgtcattctttttctcttcgaataaatgtttttaagcaagaaaaaaaaaaaaaaaaa

SEQ ID NO: 2235 - DNA, 1069 bp, Rattus norvegicus
  Genbank Accession No. NM_031099
tcgcttgcgtcctggaggtgctacatactgcgcatgcgtacgcgactccggtctttttccccctagcgcggccgactctgcaggtctgcgtggagccgcagttgcgggtctctgttccgcaggatggggttcgtgaaagttgtcaagaataaggcctactttaaaagataccaagtgagatttagaaggcggcgagagggtaaaactgactactatgcacggaaacgattggtgatccaggacaaaaataagtacaacacaccgaaatacaggatgatagttcgtgtaacgaacagagacatcatctgccagattgcatatgcccgtatagaaggggatatgatcgtctgtgcagcatatgcacatgaacttccaaaatacggtgtgaaagttggcctgacaaactatgctgcagcctattgcactggcctgctgctggcccgcaggcttctgaataggtttggcatggacaagatctatgaaggccaagtggaggtgaatggagacgagtacaatgtggaaagcatagacggtcagcctggtgccttcacttgctatctggatgcgggtcttgcccgaactacaactggcaataaagtttttggcgccctgaagggagctgtggatggaggcttatctatcccccatagtactaaacgattccctggctatgactctgaaagcaaggagttcaatgcagaggtgcaccggaagcacatcatgggtcagaatgtggcagactacatgcgctacctgatggaggaggatgaggatgcgtataagaaacagttctctcagtacatcaagaacaacgtgactccagacatgatggaggagatgtataagaaagctcatgctgctatccgagagaatccagtctacgagaagaagcccaagagagaagtgaagaagaagaggtggaatcgtcccaaaatgtctcttgcccagaagaaagaccgggttgctcaaaagaaggcaagcttcctcagagctcaggaacgggctgctgaaagctaaagccattttctatgaagattttttcataaagacaataaacattgatcaaagc

SEQ ID NO: 2236 - DNA, 769 bp, Rattus norvegicus
  Genbank Accession No. NM_031100
tcaggcctgggagcgtctcttttcctctggcaccccatcgacgatcctagttgtcatcatgggccgccgccccgcccggtgttatcgctattgtaagaacaagccatacccaaagtctcgtttctgtcgtggtgtccctgatgctaagatccgcatctttgacttgggacggaagaaagcaaaagtggatgaatttccactttgtggccacatggtgtcagatgaatatgaacaactctcttctgaagctctggaggctgctcgtatttgtgccaacaaatacatggtaaagagttgtggcaaggatggctttcatatccgggtgaggctccaccctttccatgtcatccgtatcaacaagatgttgtcctgtgctggggctgacaggctccagacaggtatgcgtggtgcctttgggaaaccccaggggacagtagccagggttcacattggccaagtcatcatgtctatccgaaccaagctgcagaataaggaacatgtgattgaggctctgcgcagggccaagttcaagttccctggccggcagaagatccacatctcaaagaaatggggttttaccaagttcaatgcagatgaatttgaagacatggttgctgagaagcggctcattcctgatggctgtggtgtcaaatatatccccaatcgtggtcctcttgacaagtggagagccctgcattcctgaaggcttccacagtgcgctcctatgcgctatcaaatgaggttcaataataaagtctcgcgttcaaaa

SEQ ID NO: 2237 - DNA, 722 bp, Rattus norvegicus
  Genbank Accession No. NM_031101
tcctttccgctcggccgttctcctgtacaggaggcagccatggcgcccagccggaatggcatgatcctgaagccccacttccacaaggactggcagcagcgagtggacacgtggttcaaccagccggcccgcaagatccgcagacgcaaggcccggcaggcgaaagcgcgccgcatcgcccctcgccccgcgtccggtcccatcagccccatcgtgaggtgccctacagttagataccacaccaaggtccgggctggcaggggcttcagcctggaggagctcagggtggctggtatccacaagaaaatggcacgcaccatcggcatctccgtggacccaaggaggcgaaacaaatccacggagtcactgcaggccaacgtgcagcgcctgaaggagtaccgctccaagctcatacttttccccaggaagccttctgctccgaagaagggagacagttctgctgaagaacttaaattggccacgcagctaacaggacctgtgatgcccatccggaatgtgtacaaaaaggagaaggccagagccatcacggaagaggagaagaactttaaggctttcgccagccttcgcatggcccgagccaatgcccggctcttcggcatccgagcaaagagggcgaaagaagccgcagagcaagacgttgagaagaagaaataatgcgcggctggagagttgtaataaattttccataaagcaaaaaaaaa

SEQ ID NO: 2238 - DNA, 607 bp, Rattus norvegicus
  Genbank Accession No. NM_031102
catgggtgttgacattcgccacaacaaggaccgaaaggttcggcgcaaggagcccaagagccaggatatctacctgcggctgctagtcaagctgtacaggtttctggccagacggaccaactccaccttcaaccaggttgtgctgaaaaggttatttatgagccgaactaaccggccacctctgtccctgtcccgaatgatccggaagatgaagcttcctggtcgggagaacaaaactgctgtggttgtggggacgatcacagatgatgtgcggattctggaagtgcccaagctgaaggtgtgtgcactgagggtgagcagccgggcccgaagtcggatcctcaaggctgggggtaagatcctgaccttcgaccagctggccctggagtctcccaagggcaggggcactgtgctcttgtctggtcctcggaagggccgagaggtgtaccgacactttggcaaggccccaggaactccacacagccacaccaaaccctatgtccgttccaagggccggaagttcgagcgtgccagaggccgaagggccagccgaggctacaaaaactaaccctggctcttactgttaataaaaaagctttggatgttg

SEQ ID NO: 2239 - DNA, 703 bp, Rattus norvegicus
  Genbank Accession No. NM_031103
ctttcctttcgctgctgcgtctgcagccatgagtatgcttaggctacagaagaggcttgcctctagcgtcctccgctgtggtaaaaagaaggtgtggttggaccccaatgaaaccaacgaaatcgccaatgccaactctcgtcaacagatcaggaagctgatcaaagatggcctgatcatccggaagcctgtgactgtccattcccgggctcgatgccggaagaacaccttggcccgacggaagggcaggcatatgggcatagggaagaggaagggtactgccaacgctcggatgcccgagaaggtgacctggatgcgaaggatgaggatcctgcgccggcttctcaggagataccgggaatctaagaagattgaccgtcatatgtatcacagcctgtacctgaaggtcaaagggaatgtgttcaaaaacaagcggattctcatggagcacatccacaaactgaaggcagacaaggcccgcaagaagctactggctgaccaggctgaggctcgcaggtctaagaccaaggaagcacgaaagcgccgggaggagcgcctccaagccaagaaggaggagatcatcaagactctgtccaaggaggaagagaccaagaaatgaagcgtccctcgtgtctgtacatagtggccaggctatggcctcacatggatcagtcattaaaataaaacaagccttcgtccttgt

SEQ ID NO: 2240 - DNA, 444 bp, Rattus norvegicus
  Genbank Accession No. NM_031105
gctgccgggtctctcgttttcatcgcagacacttctgctgcaaagatggtcaacgtacctaaaacccgaaggactttctgtaagaaatgtggcaagcaccagcctcacaaagtgacccagtataagaagggcaaggattccctgtatgcccaaggaaagcggcgctacgaccggaagcagagtggctatggcgggcagacaaagccaatttttcgaaagaaggccaaaaccacaaagaagattgtgctcaggcttgagtgtgttgagcccaactgcagatctaagaggatgctggccattaagagatgcaagcattttgaactgggaggcgacaagaagagaaagggtcaagtgatccagttctaaaacttgtgttttcttagaggaaaatactgaagcagtagaataatgacctgctagagaataaaagttattgttactggt

SEQ ID NO: 2241 - DNA, 366 bp, Rattus norvegicus
  Genbank Accession No. NM_031106
ttccggtctctttggcctcgccggtagaagcaagatgacgaaaggaacgtcatcctttggaaagcgtcgcaataagacgcacacgctgtgccgccgctgtggctccaaggcctaccaccttcagaagtcgacctgtggcaaatgtggctaccctgccaagcgcaagagaaagtataactggagtgccaaggctaagaggcgaaacactaccgggactggtcggatgaggcacctaaagatcgtctaccgaagattcagacatggattccgtgaaggaacaacacctaaacccaagagggcagctgttgcagcatccagttcatcttgaggatttcaatcggtcataaaataaatcttctggtttca

SEQ ID NO: 2242 - DNA, 610 bp, Rattus norvegicus
  Genbank Accession No. NM_031109
ggggggggggggggggagcctccgcctcggaccctgtagccgccgcgatgttgatgcccaagaagaaccggattgccatctatgaactcctttttaaggaaggggtgatggttgccaaaaaagacgtccacatgcccaaacaccccgagctggcagacaagaacgttcccaaccttcacgtcatgaaggccatgcagtctctcaagtctcgaggctacgtgaaggagcagtttgcttggagacatttctactggtacctcacgaatgagggcatccagtacctccgagattacctgcacctacctccggagatcgtgcccgccaccctgcgccgcagccgtcccgagactggcaggcctcggcccaaaggtccagagggtgagcggcctgcaagattcacaagaggggaggcagacagagacacctacagaaggagcgctgtgccccctggagctgacaagaaagctgaggctggggctggctcggcaacggagttccagtttagagggggtttcggtcgtggacgtggtcagccacctcagtgaagttggagattatgttgtgttgaataaactttaaaaaaaaaaaaaaaaaaccccccccccccccc

SEQ ID NO: 2243 - DNA, 534 bp, Rattus norvegicus
  Genbank Accession No. NM_031110
agatggcggacattcagacggagcgtgcttaccaaaagcagcctacaatctttcaaaacaagaaacgtgttttgctgggagaaactggcaaggaaaaactccctcggtactacaaaaacatcggtctaggcttcaagacgcccaaggaggccatcgagggcacctacatagacaagaaatgccccttcactggtaatgtctccatccgaggacggatcctgtctggtgttgtgacgaagatgaagatgcagaggaccattgtcatccgccgggactatctccattatatccgaaagtacaaccgctttgagaagcgtcacaagaacatgtctgtgcacctgtccccctgtttcagggacgtccagattggcgacattgtcactgttggagagtgcaggcctctgagcaagactgttcgattcaatgtgctcaaggtcaccaaggctgctggcaccaagaagcagttccagaagttctgaggggggactgtagccaatgctctagaacaaataaaagttattttccaacttacag

SEQ ID NO: 2244 - DNA, 359 bp, Rattus norvegicus
  Genbank Accession No. NM_031111
tttctgtgttctccgtagacccgtgagcagggacggcctcggtatgcagaacgacgccggcgagtttgtggacctgtacgtgccgcggaaatgctccgcgagcaaccgcatcattgctgccaaggaccacgcgtccatccagatgaatgtggccgaggttgacaggagtacaggccgatttaatggtcagtttaaaacctacggcatctgcggggccattcgcaggatgggcgagtcagatgattctattctccgattggctaaggctgatggaattgtctcaaagaacttttgagccagaagaaatcgggaataatttgttataaataaaagtgataataagtaaaaaaaaaaaaaaa

SEQ ID NO: 2245 - DNA, 466 bp, Rattus norvegicus
  Genbank Accession No. NM_031112
tcctcctttacagctcgggcaccgtagccatcatgaatgacacggtaaccatccggaccaggaagttcatgacaaaccgtctgcttcagaggaaacagatggtcattgatgtccttcatcctgggaaggccacagtaccaaagacagaaattcgggaaaagctggccaagatgtacaaaaccacaccagatgtcatctttgtatttggattcagaacccactttggtggaggcaagacaactggctttggcatgatctatgattctttagattatgcaaagaagaatgagcctaaacacagacttgcgagacatggcctttatgagaagaaaaagacctcccgcaaacagcgaaaagaacgaaagaacagaatgaagaaggtcagggggactgcaaaggccaatgttggtgctggcaaaaagccaaaggagtagttctacggtgacttgatgttctgctgtgatat

SEQ ID NO: 2246 - DNA, 552 bp, Rattus norvegicus
  Genbank Accession No. NM_031113
  misc_feature (1)..(552): n = a or c or g or t
cttcctttccgatccgccatcgttggtggagcagccgccacgatgcagatttttgtgaagacccttacagggaagaccatcacgctcgaggttgaaccctcggacactatagaaaatgtaaaggccaagatccaggataaggaaggaattcctcctgatcagcagaggttgatctttgctggtaagcagttggaagatggccgtactttgtctgactacaacattcaaaaggagtccactctccatctcgtgctgagacttcgtggtggcgctaagaaaaggaagaagaagtcttacaccaccccaaagaagaacaagcataagagaaagaaggtcaagttggctgtgctgaaatactataaggtggatgaaaatggcaaaatcagccgacttcgtcgggaatgtccttctgatgaatgtggtgctggagttttcatgggtagccactttgacaggcattactgtggcaagtgttgtctgacttactgcttcaacaaaccagaagacaagtagttgtgtatgagttaataaagagaaggaactgatgttaan

SEQ ID NO: 2247 - DNA, 573 bp, Rattus norvegicus
  Genbank Accession No. NM_031114
aagactgcagcgcctcagggcccaggtttcaacagattcttcaaaatgccatcccaaatggagcatgccatggaaaccatgatgcttacatttcacaggtttgcaggggaaaaaaactacttgacaaaggaggacctgagagtgctcatggaaagggagttccctgggtttttggaaaatcaaaaggaccctctggctgtggacaaaataatgaaagacctggaccagtgccgagatggaaaagtgggcttccagagctttctatcactagtggcggggctcatcattgcatgcaatgactattttgtagtacacatgaagcagaagaagtaggccaactggagccctggtacccacaccttgatgcgtcctctcccatggggtcaactgaggaatctgccccactgcttcctgtgagcagatcaggacccttaggaaatgtgcaaataacatccaactccaattcgacaagcagagaaagaaaagttaatccaatgacagaggagctttcgagttttatattgtttgcatccggttgccctcaataaagaaagtctttttttttaagttccg

SEQ ID NO: 2248 - DNA, 1694 bp, Rattus norvegicus
  Genbank Accession No. NM_031122
gcgtcgacgggcttggcatcgggcctccgcagccgcccaccgccagaagcttccagcctcaccactatggatccccgcaaagtgagcgagcttcgggccttcgtgaagatgtgtaggcaggacccgagcgtcctgcacaccgaggaaatgcgtttcctgagggagtgggtggagagcatggggggtaaagtaccacctgctactcataaagcgaagtcagaagaaaacactaaggaagaaaaaagagacaagacgacagaggacaacataaagacagaggagccatcgagtgaggagagcgatctagaaattgacaatgaaggtgtaattgaagcagacactgatgctcctcaggaaatgggagatgaaaatgcagagataactgaggcgatgatggatgaagcaaatgaaaagaagggggctgccatcgacgctctaaatgatggtgagctccagaaagccattgacttgttcacagacgccatcaagctaaaccctcgcttggccattctgtatgccaagagagccagtgttttcgtcaaattacagaagccaaatgctgccatccgagactgtgacagagctattgaaataaaccctgattcagctcagccatacaaatggagagggaaagcgcacagactcctgggtcactgggaagaagcagctcgcgatcttgccctggcctgtaaattggactatgatgaggacgccagtgcaatgctgagagaagtccagcctcgggctcaaaaaattgctgaacatcggagaaagtatgagcgaaaacgtgaagagcgagagataaaagaacgaatagaaagggtgaagaaggctcgagaagagcatgaaaaagcccaaagggaagaagaagccagaagacaatctggatctcagtttggctcttttccaggtggttttcctgggggaatgcctggtaattttcctggaggaatgcctggaatgggaggggccatgccaggaatggcaggaatgcctggactcaacgaaatcctcagtgacccagaggttcttgcagccatgcaggatccagaagtcatggtggctttccaggatgtggcccagaacccatcaaatatgtcaaaatatcagaacaacccaaaggttatgaatctcatcagtaaattgtcagccaagtttggaggtcactcataatgtcaaagcccttgctgaatgaagaacagcttagctcacttactggatgttgcaataatacaaaccagtgtacctctgacctcaccagagagctggggcgcttcgaagataatccctaccctctgcatcatatgcggctgaggcatattacagtggtttgccattagagtgttcattcagataatgttttcctattaggaattacaaacttaaaacatttttcaaccttaaacatattttttaaaaatttaggggatgtcaattcctacatttttcgttactaatctttttgggtttttccttttgaattactgggcaaggaaggtgaatgtggatgatttactgctttcatgaatgaaataaagatttgttagtgggaagcaaataaaacacatttaagttgattgagtcggacatacggttactgcaacatcttgaattgtctttaatgttttacttcacaatgatctatttcagtaaatcttttgggaccaccaaaaaaaaaaaaaaaaaaaaaaaaa

SEQ ID NO: 2249 - DNA, 1004 bp, Rattus norvegicus
  Genbank Accession No. NM_031123
aagctttcagtatatccagatccacatcttcactcaagccgggagagggaaagaggaaagggggggaggaaaaaaaaaagccaacaacttagcggaaacttctcagagaatgctccaaaactcagcagtgattctggcgctggtcatcagtgctgctgcagctcacgaggcggaacagaatgattctgtgagccccagaaaatcccgggtggcggctcaaaattcagctgaagtggtccgctgcctcaacagtgccctacaggttggctgtggggcttttgcatgcctggaaaactccacatgtgacacagatgggatgtacgacatttgtaaatccttcttgtacagtgctgctaaatttgacactcagggaaaagcatttgtcaaagagagcttaaagtgcatcgccaatgggatcacctccaaggtcttccttgccattcggaggtgttctactttccagaggatgatcgccgaggtgcaggaggactgctacagcaagctcaatgtttgcagcattgccaagcgcaacccggaagccatcactgaagtcatacagctgcccaatcacttctccaacagatactacaacagacttgtccgaagccttctggaatgtgatgaagatacggtcagcacaatcagagacagcctgatggagaagatcgggcccaacatggccagcctcttccatatcctgcagacagaccactgtgcccagacacatcccagagctgacttcaataggaggcgcacaaatgagccacagaagctgaaagtcctcctcaggaacctccgaggtgagggggattctccctcacacatcaaacgcacctcccaagagaatgcgtaagcagggagaggtattcacagcctcaccaaactaatagcgttttaggggtgtttacacaccaactttgagtgtactgtgcctggtttgatttttttttaagtagtacctattttctatccccccttaaagaaaactgcatgaaactaagctt

SEQ ID NO: 2250 - DNA, 1054 bp, Rattus norvegicus
  Genbank Accession No. NM_031124
cccgcagttgctccaggccgctcacttgggacgcgcttacctgagacaaggcgcctgccaccctcacctggaccaggatgaaggaccgactggagcagctgaaggccaagcagctgacgcaggatgatgacacggacgaggttgagattgctattgataatacagcgttcatggatgagttcttttctgagattgaggaaacgaggctcaacatcgacaagatctcagagcatgtggaggaagctaagaaactctacagtatcattctctctgcaccgattccagagccaaaaaccaaagacgaccttgaacagctcacaactgagatcaagaaaagggccaacaacgtccggaacaaactgaagagcatggagaagcatattgaggaagacgaggtccggtcatcagcagaccttcggatacgaaagtcccagcactccgtcctctcccggaagtttgtggaggtgatgacaaagtacaatgaggcacaggtggacttccgtgaacgcagcaaagggcgcatccaacggcagcttgaaattactggcaagaaaacaacagatgaggagctggaagaaatgttggagagtggcaacccagccatcttcacttctgggatcattgactcccagatttccaagcaagccctcagcgagattgagggtcggcacaaggacatcgtgaggctggagagcagcatcaaggagctccatgacatgtttatggacatcgccatgctggtggagaatcagggtgagatgttagataacatagagttgaatgtcatgcacacggtggaccatgtggagaaggcacgggatgaaactaaaagagccatgaagtatcagggtcaggctcgaaagaaattgataattatcattgtgatagtagttgtgttgctgggcattttagcgttgattattggattgtccgttgggctgaaataagagtggcctaaggggctgctgcactgaaatcttggcctgaccactcttgtctccagatgggaacaaagattaaatggccttcctgagaatgaggggtactgttcttt

SEQ ID NO: 2251 - DNA, 1777 bp, Rattus norvegicus
  Genbank Accession No. NM_031127
cagcctcaccttttctgatgataactcaaggactcggggatggaaagtcatggggaccctgataggccttggtgccgtgctggcctatcatgaccatcggtgtagggcttctcaggagtcaccacggatatactctaaagaggatgtgcgttctcacaacaaccttcaaactggagtctgggtaactctaggctctgaggtcttcgatgtcacaaaatttgtggacctgcatccaggaggacaatcaaaactgatgctagctgctggaggtcccctagaacccttctgggccctctatgctgttcacaaccagccccatgtacgtgagttactggctgagtataagattggggagctgaaccccgaagatagaatgtcccctcccttggaggcctctgacccttattccaatgaccctatgcgtcatccagccctgaggattaatagccagcgcccctttaatgcagagcctcctcctgaactgcttacagaaagctacatcacaccaaaccctattttctttacccggaaccatctgcctgtacctaacctggacccagacacctatcgcttgcatgtagtaggggcacctggaggtcagtcgctctctctctccttggatgatttgcataagttccccaaacatgaggtcactgtcactctgcagtgtgctggtaaccggcgctcggagatgaataaggtcaaggaagtgaaaggtctggagtggagaacaggggccatcagcacggcacgctgggccggggcacggctctgtgatgtcttagcccaggctggtcaccgactccgtgaaaccgaggcccatgtctgttttgaaggactggattcagaccccactggaactgcctatggggcatccatccctctggctcgggccatggatccccaagccgaggtcctcctggcttatgagatgaatggtcagcctctgcctcgtgaccatggcttccccgtaagggtggtggttcctggtgtggtaggtgctcgccatgtcaagtggttgggcagagtgagtgtggagtcagaggaaagttatagtcactggcagaggcgggattacaaaggcttttctccatctgtggactgggacactgtagactttgatctagccccatcaattcaggaactacccatccagtcagctatcacacagcctcaagatgggacgactgtagaatcaggagaggtgattatcaagggctatgcatggagtggtggtggtagggctgtgattcgagtggatgtgtctatggatggtggactgacctggcaggaagctgagctggagggagaggaacagcatcccaggaaggcctgggcttggcgaatatggcagttgaaagctcacgtgccagctgagcagaaggaattgaacatcatttgtaaagcggtagatgacagttacaatgtgcagccagacactgtggccccaatctggaaccttcgaggcgtgctcagcaatgcctggcaccgtgtccacgttcaggtggttccatgaaagcatggaacagcagtttgtacccaaaggacccctacacctctttaccaacccagccttaatcctcggtgccatagataaacgtttccttcctctactgaggggagaaagcagctctcaagacatcactttcttaccctaccatacctttacttctcatgcctcccctcaggccttgttttgcattgcttagattcttcagatatgtgtgtgatgtatggaatgtgtaaaaactgtacgttatttctttttcttcttccc

SEQ ID NO: 2252 - DNA, 357 bp, Rattus norvegicus
  Genbank Accession No. NM_031129
atggacgtgtttctcatgatccggcgccacaagaccaccatctttacggacgccaaggagtcgagcacggtgttcgaactgaagcgcatcgtcgagggcatcctcaagcggccgccagaggagcagcggctgtacaaggacgaccagctccttgatgatggaaaaactctgggcgaatgtggcttcaccagtcagacagcaaggccacaggccccagccacagtgggcctggcctttcgagcagatgacacctttgaagcgctgcgtattgaacccttctccagccctccggagcttccagatgtgatgaagccacaggattctggaggcagtgccaatgaacaagctgtgcagtga

SEQ ID NO: 2253 - DNA, 2880 bp, Rattus norvegicus
  Genbank Accession No. NM_031131
tcagagccctcaccctctcccttccaggagaaaaaacaaacctttcttactccttaaagtgagagatccccctcctgcctccctagcatcgcatattaatatctccacgttgggaacgcgttgcattttcttttttaaaggaatcctagccagggacgtttttctattgggcattgactttcaactgctttgcaaaagtttcgtattaaaaacaactctacctgacccgctctgagaattactagtttctttttatatttttttcttactttaaacaacaacaacaacgtttcctccttttaaaaacatgcactactgtgtgctgagaacctttttgctcctgcatctggtcccggtggcgctcagtctgtctacctgcagcaccctcgacatggaccagtttatgcgcaagaggatcgaggccatccgcgggcagatcctgagcaagctgaagctcaccagccccccggaagactatccggagccggatgaggtccccccggaggtgatttccatctacaacagtaccagggacttactgcaggagaaggcaagccggagggcagccgcctgcgagcgcgagcgaagcgacgaggagtactacgccaaggaggtttataaaatcgacatgccgtcccacttcccctccgaaactgtctgcccagttgttacaacatcctctggctcagtgggcagcttttgctccatacagtcccaggtgctctgtgggtaccttgatgccatcccgcccactttctacagaccctacttcagaatcgtccgcttcgatgtctcaacaatggagaagaatgcttcaaatctggtgaaggcagagttcagggtctttcgcttgcagaaccccaaggccagagtggctgaacaacggattgaactgtatcagatccttaaatccaaagacctaacatctccaacccagcgctacattgatagcaaggttgtgaaaaccagagccgagggggaatggctctccttcgacgtgacagacgccgtgcacgagtggcttcaccacaaagacaggaacctgggatttaaaataagtttacactgcccctgctgtaccttcataccgtctaataattacatcatcccaaataagagccaagagctggaggcgagattcgcaggtatcgatggcacctccacatatgccagtggtgatcagaaaactataaagtccactaggaaaaaaagcagtgggaagaccccgcatctcctgctaatgttgttgccctcctacagactggagtcccagcagtccagccggcgacggaagcgggctttggatgccgcctattgctttaggaatgtgcaggataattgctgccttcgccctctttacattgattttaagagggatcttggatggaaatggatccatgaacccaaaggatacaatgctaacttctgtgctggggcatgcccttatctgtggagttcagacacacaacacaccaaagtcctcagcctgtacaacaccataaaccccgaagcttctgcttccccttgctgtgtgtcccaggatctggaaccactgaccatcctctactacattggcaatacgcccaagatcgaacagctttccaacatgatcgtcaagtcttgtaaatgcagctaaagtcctcgggaaagccaggatgaaaatcacggtgacaatgacgtatgacgacaatgacgatgataatgttcgtgacgtgagggagttttgattcatcagtgttgaaaaaaaaattggaggaaaaaaaaatcggtactagttcaaacactttgcaagcttgtgttctgtttgttaaaactggcatctgggattacagcaacaacagccacaaaaatggaaggcgctagtctgcatctcacctacttcctgagagacacaaaaagaaaacatcttttttttttaaaggaaaaaataaacactggaagaatttgttagtgttaattatgtgaaagaaaaaacaaaacaaaacaggaaaatccgttcagtggagttgtatgtattgtttccaccccattcttcaccccacgcctctcttgtttcctctgtattgctctgcaatgggcgccctccccatcccttcctctgagttaacagtgggttatttattgtgttactatataatgaacctttcattgcccttggaaaataaaacaggtgtataagtggagaccaaatactttgccacaaactcatggatggcttaaggaatttggactcaaataagccagggggaaggaggtcatactggatgaccccctgtgagccgttatagaactgagcaagtctgagaaaaaaaaatcaaagccccagaaaacatgtgctgtgcactgcctgccgaagcttcatgagcagccatctgtccagaaggcctgttaacaagaaaacttggaatcagtgggaatctggaagattggttttttttccttctaattgtaaatggttctttgccagtttaagcaagccggtgaaatggtgacctgcttggatgtgtattgtcagacttttgaccgtgaagtggctgttgatctacaatacaggttttttttttccctttgtctcggtatacggtaattacatggatattattaaaatagacgggtctagaagccagcatgatgaaaacacactgcaaatctgttttacaaactattaaatcgaaacagtaactactttacatgtaatgtgtagatcttaccacatttttaaatattctgtaataatgattatgatttagattgaacttaaatttgaactctctctctttttttaatgatcattcagactgtatgtttgcctcctttagctggccagtacctttgaataaaacccctagattttgacttgcactacaaaaaaaaaaaaaa

SEQ ID NO: 2254 - DNA, 2460 bp, Rattus norvegicus
  Genbank Accession No. NM_031134
agggtaattagacctctgcctggcggtagtagatcccgagatgaaaggggctctggcgtcactggcaggattttatgtccatgaatgcagggaacaaaccagaaacccccccaattctcccctgcgagtgaaagctattatatctgaaaatgacatctttctcaaaacgtttcaccgagcgtcgctcctggacagagccgcaggggggatgaggtatctccagacaggacaagtctctgaagacttcccagcccctaacccagtaccatttaccaagccagcttgcccctagctctcccacctgccactccccagcccctctaaccaccggccctcccgtttttttggggcacagggcatggtgtgaaaggctgagtactgagggggatactatgggtgctgtcccctagggcctgggtggcggggggtgggtggcctgtgggcgtggggggggggcagtgtgcccaccccagtctcttggcgtgctggagggcatcccggatggaattgaagtgaatggaacagaagccaagcaaggtggagtgtgggtcagacccagaggagaacagtgccaggtcaccagatggaaagcgaaaaaggaagaacggccaatgtcccctgaaaagcagcatgtcagggtatatccctagttacctggacaaagacgagcagtgtgtcgtgtgtggggacaaggccaccggttatcactaccgctgtatcacttgtgagtgctgcaagggcttctttcgccgtacaatccagaagaacctccatcccacctattcctgcaaatatgacagctgctgcgtcatcgacaagatcacccggaatcagtgccagttgtgccgcttcaagaagtgcatcgctgtgggcatggccatggacctggttctagacgattcaaagcgggtggccaaacgcaagctgattgagcagaaccgggagaggaggcgaaaggaggagatgatccgctcgctgcagcaacgaccagagcccactcctgaagagtgggatctgatccacgttgctacagaggcccatcgcagcaccaatgcccagggcagccattggaaacagaggcgaaaattcctgccggatgacattggccagtcacctattgtctccatgccggacggagacaaggtagacctagaggccttcagcgagtttaccaagatcatcaccccggccatcacccgcgtggtggactttgccaaaaaactgcccatgttctccgagctgccttgtgaagaccagatcatcctcctgaagggctgctgcatggagatcatgtccctgcgggcagctgtccgctatgaccctgagagcgacaccctgaccctgagtggggagatggcggttaagcgggagcagctcaagaatggtggcttgggtgtagtctccgacgccatctttgaactgggcaagtcactctctgcctttaacctggatgatacggaagtggctctgctgcaggctgtgctgttaatgtcaacagaccgctctggcctgctgtgtgtggacaagatcgagaagagtcaggaggcctacctgctggcgtttgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagtttggtgaagcgggaagtctccgagggccggttcttcagcaccagagcccgaagagcccgcagcagcgtctcctggagctgctccaccgaagcggaattctccattcccgagcggtctgtggggaagacgacagcagtgaggcaagctccctgagctcctcttcctctgacgaggacacggaggtctgcgaggacctggcaggcaaggcagcctctccctgaggccccttggagggcgatggggaaggagaaggagcatgctactccttctccagggcctctgccctagagctgggcacgcccacatgctgggagcaaggccacaggctggccgcctcccactcaagaccaccctcctacccctgagcacgccacacgtggccaagctcccttgttatttgttctgtagttccctctgcctgggatgcccttccccctctctatgcctggcaataccttgtccctttgaggccccactcaagtgtcacctccttccccagctctcccaggcagaaatagttgtctgtgcttacgtggttcatgcttcttctgtgacacttctcactgttttataattagtcgggcatgagtctgtttcccaagctagactgtgtctgaatcatgtctgtagcccagtgcccagtgccgggcctggcatagagtaggaactccataaaaggtatgttg

SEQ ID NO: 2255 - DNA, 3115 bp, Rattus norvegicus
  Genbank Accession No. NM_031135
ggagggaacacggtgcctcgggttgtgtacacgctccactgacagagcttcttgcagccgggcagccgctgatcacgcgtggccccgccagcccattggctgaggcctcacacacctttgccgctgattggtcgataccacgccccgccttccaccccgcccgcggcgcggggcaggcagagcggctacctgcatggggagggggggcagacagcgcggagcgcggtggcgtcgacgtctagtgtctcagtgctccgtctgtggctaggcagccagcagccaagcagctcgcgacctacggccaggcagccaaccatgcttaacttcggcgcttctctccagcaagcttcggaggggaaaatggaactaatttctgaaaagtccaaagagggagcacatccctgggacaaagctgaacagagtgactttgaagctgtggaagcgctcatgtccatgagctgcgactggaagtctcacttcaagaaataccttgaaaacaggcctgtcacaccagtgtctgatacctcagaggaagacagtttgcttccagggacgcctgaccttcagaccgtcccagcattctgtttgactccaccttacagcccctctgacttcgaaccctcgcaggggtcaaatctgacggcaccagcgccacctactggtcacttcagatcgctctccgatgctgccaagcctcccagcatcgctccttttaaagaggaggaaaagagcccattagctgcccctcccctccctaaggctcaagccaccagtgtcatccgtcacacagctgatgcccaactctgtaaccaccagtcctgccctgtgaaagcagctagcatcctcaactaccaggacaattctttccggagaagaacccacataaatgtcgaggctactcgaaagaacataccctgtgctgctgtgtcaccaaacagacccaagcctgagcccagcacagcggcgaatggcgctgagaaggccggcactgcgccgtatgactttgctgtgccttcctcagagacagtcatctgtaggtcttctcagccagctcccacgtccccagtacagaagtcagtactgatgtcttcacctacagtgtccactgggggagtgccacccttgcctgtcatctgccagatggttccccttccagcaaacaactctctcgttaccacagttgtccccagcagtccgcccagccagccacccgctgtctgctcacccgtgttgttcatgggcactcaggtgcccaagggcacggtcatgtttgtggtaccccagcccgttgtacagagcccaaagcctccagtggtgagccccaatggcaccagactgtctcccattgcccctgcgcctggattctctccttcagcagcaagggttactccccagattgattcgtccagagtaagaagtcacatctgtagccacccaggatgtggcaagacttactttaaaagttcccatctgaaggcccacgtgagaacacacacaggggaaaaacctttcagctgcagctggaaaggctgtgaaaggaggtttgctcgttccgatgaactgtccagacaccggcggacacacacaggtgagaagaaatttgcctgtcccatgtgtgaccgtcggttcatgagaagtgaccatttaaccaaacatgcccggcgacacctatcagccaagaagctgccaaactggcaaatggaagtgagcaagttaaatgacatcgctctgcctccggccacagcgtcggcacagtgacggccagaagatggagactcagaataaactttggtcagagtcgagccggtgaccgtgtcaaatgcttctgcaagtctgcggccctccaacagggcctaaagcagaagcccctggcctggggggaggcccagcctgggttagatgacgagaagtgcttcagccacaggcagttcacagaagggcggggttcatttcttaccacgtagagagatgagaacactcgtgtcccttgagtagttttggaaggtttcggatgagatgagcacagcacaggttttgaatcacatacacatcaggtactttgtttttgccatttatacttgagaccagctttgcagtgtgattcttttaaagcgttggtttcgagaatatagaggctgaaattacggtacagaaatgcagctagaaagtgagtttgtgtcatcttctcctagagttatcttgcttattattcctagtctttacagtcaactccgtggacgtggctaagtatagaaaactatcatttcttccactgttgttggtatttgaggttgaacagctgtacattgctaaggggagcccaaggattggaactctcattaatttaattgcttggaagtgcagctaaagttcttttttttggccttttgttttgaaagtttaggcattttactctaccttagatattagtttgcttgcagttttttgtgtagatttgaaaactgtacaccaatgtgtttcctatagacttaagatacgctgcgctttgtttagaaaacaatctggcagtgaaaatatgtgtcgtaaagaagagatgtcaagaatttgagatgactccttgagaaagatggcttatgtcatcagcaaaggacacttacgtcagacgtacactgtttctatcaaatcaggaagttagtgaccatcacagatggacaggtgtccttttatttataggagtttgtcaggatgtctgagtagataggtaggaaattgttactagaacattcacttccgacttgacaaggatattcatggtgcagatacgttcttcctgccgctgcagtgtctgggtgtccgggaaactccgagactttaaagtgtcataatgtggtcacacctgcagttctggggatccagagccttgcttgtgttctgtaagctctgtcaccgagttgtatccccacctgaaagcagtgacttttgctaacagtatttctgttctgttgtaaagtggatagaagacacacttggtagtaaaggtaaattattcaaagtccacagtgaaaaactcaccataccttcccatttaaaccgtttctgtatctcataggtttctgacatgcaaacttgaacccttgaaaaaaagagttttctt

SEQ ID NO: 2256 - DNA, 686 bp, Rattus norvegicus
  Genbank Accession No. NM_031136
gcggcctctgagcagatcgtctctccttgttcgcccagctcgctcagctccttccagcaaccatgtctgacaaacccgatatggctgagatcgagaaattcgataagtcgaagttgaagaagacagaaacacaagagaaaaatcctctgccttcaaaagaaacaattgaacaagagaagcaagctggcgaatcgtaatgaggcgagcgccgccaatatgcactgtacattccacgagcattgccttcttattttacttcttttagctgtttaacttcgtaagatgcaaagaggttggatcaagtttaaatgactgtgctgcccctttcacatcaaagaatcagaactactgaccaggaaggcctccccccgcctctcccgcccacctgctggcctggctggcagagagggaaaagaacttgcatgttggtgaaggaaaaagctgggtgggagatggtggaattgagagtaaaataaagatgtcttgcaggatataaaatgcagtttaatcagagtgccatttttttttgttcaaacgattttaattattggaatgcacaatttttttaatatgcaaataaagttttaaaacctgaaaaaaaaaaaaaaaaagaaacaacagtcgttatggccataaaacacatcatctgtgattttggagagaaccactggaaagaaagtttgagg

SEQ ID NO: 2257 - DNA, 4566 bp, Rattus norvegicus
  Genbank Accession No. NM_031137
ccagcttgcgtccatggccaccgctgcgaccgaggagcctttccctttccatggtcttctaccaaagaaagagactggggcctcctccttcctgtgccgctacccggagtatgacggacgcggggtgctcatcgccgtcctggacacaggggttgatcccggggccccgggcatgcaggtcacgactgatgggaaaccaaaaatcattgatatcattgatacaacaggaagtggtgatgtgaatactgctacagaagtagaaccaaaagatggcgaaatcactggtctttctggaagagtgcttaagattcctgcaaactggacaaatccttcaggaaaatatcatattggcattaaaaatggttatgacttctatccaaaggctctcaaggaaaggatacagaaagaacggaaggaaaaaatctgggatccaattcacagagttgcgcttgcagaagcttgtagaaaacaagaagaatttgatattgccaataatggctcttcccaagccaataaactaatcaaggaagagttgcagagtcaagtggaattacttaattcttttgagaaaaagtatagtgatccaggccctgtgtatgactgcttggtgtggcatgatggtgagacctggagagcctgtgttgattcgaatgaaaatggggacttgggtaaatctactgtattgagaaactacaaagaggctcaagaatatggttcttttggcacagctgagatgctgaattactctgttaatatttatgatgatggaaacctgctctccattgtgaccagtggaggagctcatggaacccatgtagcgagtatagctgctgggcattttccagaagagcctgaacggaatggagttgctcctggtgctcaaattctatccattaagattggtgatacaaggctaagcaccatggaaacaggcacaggcctcatcagagctatgatagaagttataaatcataagtgtgatcttgtcaactacagttatggagaagcaactcattggccaaattctgggagaatttgtgaagtaattaatgaagcagtatggaaacataatacaatttatgtttcaagtgctggaaataatggtccatgcctttctacagtgggttgtccaggaggaactacttccagcgtgataggtgttggagcttatgtttctcctgatatgatggttgcagagtattcactgagagagaaactacctgcaaatcaatatacatggtcttctagaggcccaagtgctgatggggcccttggtgtgagcatcagtgcaccaggaggtgctattgcttctgtgcctaactggacattgagggggactcagctaatgaatgggacatcaatgtcttcccccaatgcctgtggtggcattgccctggtactttcagggctgaaagcaaataatgttgactatactgttcactcagtcagaagagctctagaaaacactgcaataaaagctgacaatatagaagtatttgcccaaggacatggaattattcaggttgacaaagcttatgactacctcattcagaatacatcatttgctaacagattaggttttacagttacagttggaaataaccgtggcatctacctccgagatcctgttcaggtggctgctccttcagatcatggtgttggcattgagcctgtatttccagagaacacagaaaactctgaaaaaatatccttccagcttcatttagctttaacttcaaattcatcttgggttcaatgtcccagccatttggaactcatgaatcaatgtcggcacataaacatacgtgtggaccccaggggcttaagagaagggttacattatacagaggtatgtgggtatgatatagcatcccccaatgcaggtcctttattcagagttccaatcactgcagttatagcagcaaaagtaaatgaatcatcacattatgatctagcctttacagatgtacattttaaacctggtcagattcgaagacattttgttgaggttcctgagggggcaacttgggctgaagttaccgtgtgttcgtgttcttctgaggtatcagcaaaatttgttcttcatgcagtacagcttgtgaagcagagagcatatcgaagtcatgaattttataagttttgttcccttccagaaaaaggaacactcattgaagcctttcctgttctgggtgggaaagcaattgaattttgtattgctcgttggtgggcaagtctcagtgatgtcaatattgattataccatatcattccatggcatagtgtgtactgcaccacagttaaacattcatgcatctgaaggaatcaatcgttttgatgtccagtcctctttaaaatatgaagatctggctccttgcataactttgaagagctgggtgcaaacactacgcccagtaaatgcaaaaaccagacctttaggatcaagagatgttttgccaaataatcgccagctttatgagatggtcctgacatacagctttcatcagcccaagagcggagaagtaacacctagttgtccactcctttgtgaattattatatgagtcagaatttgacagtcagttgtggattatttttgaccagaacaaaagacagatgggctcaggcgatgcctatccacatcagtattctttgaaattggagaaaggagattatacgattcgattacagattcgtcatgagcaaatcagtgatttggatcgtctcaaagatcttccgtttattgtttcgcataggttgtctaataccttgagcttagatattcatgaaaatcatagccttgcacttctaggaaagaagaaatcaagcagtttgacattaccacccaaatataatcagccattctttgttacttccttacctgatgataaaatacctaagggggcaggacccggatgctaccttgcaggctccttgacattgtcaaagactgagcttggaaagaaagctgatgtgatccctgttcattactatctaatacctccaccaacaaagactaagaatggcagcaaagataaagaaaaggattcagaaaaagagaaagatttgaaagaagagtttactgaagctttacgagatcttaaaattcagtggatgaccaagctggattctactgacatttacaatgaattgaaagaaacatatcctgcttaccttcctttgtatgttgcacgtcttcatcaattagatgctgaaaaggagcggatgaaaagacttaatgaaattgttgatgctgccaatgctgttatttctcacatcgatcagaccgctctcgctgtttacattgccatgaagactgaccccaggcctgatgcagctactataaaaaatgatatggacaagcagaaatctaccctggtagatgccctctgcaggaaaggatgtgctctggcagaccaccttcttcatgcacagccccacgatggggcagcagctggagatgcagaagcaaaagaagaggaaggagaaagtaccttggaatctctatcagaaacctattgggaaactacaaagtggacagatctttttgacactaaggttttgacatttgcatacaagcatgcattagtaaataagatgtacgggagaggccttaagtttgcaaccaaactcgtagaagaaaaaccaacaaaagaaaactggaaaaattgtattcaactgatgaaattactcggatggacccattgtgcgtcttttactgaaaactggctccccatcatgtatcctcctgattattgtgtattctaaaatgggaaccaaaacgttaaatttcgaaagcagaaaattttatagtgaacaaatatatgaacaaatgtgtggcatttctagtctaactaatgcatgtcttcatccactatcgaatactgatcattaaaactctatgtatttatcagagaactcaatggtgtgtggcttcatacatgtaatgtagacagacctctgacatcatgctgctttcctgctgcctcccacacttggctagggagggcagagcctgcctgccagccccaacctgggtggatgcagctgctcactgcaggagaggttttcatctcttaatttttaactgtaaaacgtcatccagtttttattttataaatcaaaaaggttaaaacatgctaaatttttccaattatatagaggccttaaaaatgctacattgggtgtagctaaattatttatttgactaaaaattacgagaacataatttccagacttctaaaaataaattcaattaatgggtatggtggggaggtataaatacatggcaactgggaaaagaaacgtgttaatgtaatcttcactccggagtcacaacaagcaagttgtttttacagcatcctcaagtacacagcatcagaataagttaaaatttcatgtgttggtgccagacagttgaatctatctggttttgtaaagatatacacagtatgtttataacattgaaatcatgtaaaatacatgaataaatgtgcaaaacaacaggcacagcacaccatatgcactctgatacctgttttttataaataaaagtaaatattgaagctaaa

SEQ ID NO: 2258 - DNA, 1737 bp, Rattus norvegicus
  Genbank Accession No. NM_031138
  misc_feature (1)..(1737): n = a or c or g or t
ggggcagctgcggagcatgtcgaccccggcccgtaggaggctcatgcgggatttcaagcgattgcaagaggacccacctgtgggggtcagtggtgcaccatctgaaaacaacatcatgcagtggaacgcagttatatttggaccagaagggacaccctttgaagatggtacttttaaactagtaatagaattttctgaagaatatccaaataaaccaccaaccgttaggtttttatccaaaatgtttcatccaaatgtgtatgctgacggcagcatatgcttagacatcctgcagaaccgatggagccccacgtacgacgtctcctccatcttaacttcaattcagtctctgttggatgagccgaatccaaacagtccggccaatagccaagcagcacagctttatcaggaaaacaaacgggagtatgagaagagggtttcggccattgttgagcagagctggaatgactcataatagacacctggtctgtccacctttccatcgtcgttgtgtataatttacctcccagtaggaaggctagcaagttttaagtgccacgggttttaaggattctgcagagaaaaaagaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaaaaaaacaggcatctggactcaatggtacctgattaagcccattcctctcagacacttggatgggagacccacacctggactcttttgagcttcagttgatggaattagtgcagcttgagtcagctcaacggggtctctgtgacttgtcctccttcttctgagaccttgcctgtgaaagtattcaaaacacctgcagtattgcctttagcgagttctcatagcaaaggacatagggtgggtgggactggattcgcaggtgaaattaaacctgacagggccgtgtgtttgcattttaatttgatatactcctgaacagtccatctctgacatgctctgccacaacccttctgtgtgtttccttagttactgctaccaaatatccgtgcagccctgcattactgtttccctgggtaccgctcatccccagcccctgaaagccccctggaggtggggaagctgtccccgttgcattcatcttacacacttgcaggctagcgcatgccacacgctctattagtactggtggcttgagtaaataagcaagttcacagctatcgccctctgcagtgcttcaaacactaatgtcttctaacaaatacaactttagtgatcactttgatgccattgaacatgaaacaggtttcttgttgatactagaagatatgtcagaggactcattcaagcctcttctcctgtttttttcgtgacacacatcgataagaagctgattttttttagactaaaatgcataacttaaaatatcttgngaattttttttaaaaggaagggatagaaaaaatatgtcatgaagaaggagaaaaaaaaaaaaaaaaaaaaa

SEQ ID NO: 2259 - DNA, 1796 bp, Rattus norvegicus
  Genbank Accession No. NM_031140
gttcacagccactgcgccctcgctctcttcttgcagatcttgcagccgcagcaagccaggccacctcgtccttcgaagccatgtccaccaggtccgtgtcctcgtcctcctaccgcaggatgttcggtggctccggcacatcgagccggcccagctccaaccggagctatgtgaccacatccacccgcacctacagcctaggcagcgcgctgcgccccagcactagccgcagcctctattcctcgtccccgggtggcgcctatgtgacccggtcctccgccgtgcgcctgcggagcagcatgcccggcgtgcggctgctgcaggactccgtggacttctcgctggccgacgccatcaacaccgagttcaagaacacccgcaccaacgagaaggtggaattgcaggagctgaatgaccgcttcgccaactacatcgacaaggtgcgcttcctcgagcagcagaacaaaatcctgctggccgagctcgagcagcttaagggccagggcaagtcgcgcctgggcgacctctacgaggaggagatgagggagttgcgccggcaggtggatcagctcaccaatgacaaggcccgtgtcgaggtggagagggacaacctggccgaggacatcatgcggctgcgagaaaaattgcaggaggagatgctccagagggaggaagccgagagcaccctgcagtcattcagacaggatgttgacaatgcttctctggcacgtcttgaccttgaacgtaaagtggaatccttgcaggaagaaattgcctttttgaagaagctgcacgatgaagagatccaggagctgcaggcccagattcaggaacagcatgtccagatcgatgtggacgtttccaagcctgacctcaccgctgccctgcgtgatgtccgccagcagtatgaaagtgtggctgccaagaacctccaggaggccgaggaatggtacaagtccaagtttgctgacctctctgaggctgccaaccggaacaacgatgccctgcgccaggcaaagcaggagtcaaacgaataccggagacaggtgcagtcactcacctgcgaagtggatgcccttaaaggcactaatgagtccctggagcgccagatgcgtgaaatggaagagaattttgcccttgaagctgctaactaccaggacactattggccgcctgcaggatgagatccagaacatgaaggaagagatggctcgccaccttcgtgaataccaggacctgctcaatgtaaagatggctcttgacattgagatcgccacctacaggaagctgctggaaggggaggagagcaggatttctctgcctcttccaaacttttcttccctgaacctgagagaaactaacctggagtcacttcctctggttgacacccactccaaaagaacactcctgattaagacggttgaaaccagagacggacaggtgatcaatgagacttctcagcaccacgatgaccttgaataaaaactgcacaggctcagtgcaacggcgcagtaccagcaagaaggaaaaaaaaatcgtatcttagaaaaaagagctttcaagtgcctttactgcagttttcaggagcgcaagatagatctgggatagaaacgagctcagcacataacaactgacacccccaaaaggcgtagaaaaggtttacaaaataatctagttttacgaagaaatcttgtgctagaatactttttaaagtatttttgaataccattaaaactgctttctttttccagaaaatatctgaccaacttgttactgcttcaataaaacttcagaaat

SEQ ID NO: 2260 - DNA, 3560 bp, Rattus norvegicus
  Genbank Accession No. NM_031143
ggagcggaggctgcttccccggcacctgggagtgggtcgcggggacgcgaaggcacagggcgggcggacgcgccttcgccatgagcttggcggcggtgcggaccgggcgtgctgagctccggccgccggcccggcatgggcgtctcccgcgagcccgctgccggccggggctagggccggatggagccgcgggaccccagccccgaggcccggagcagcgactcggagtcggcctccgcctcgtccagcggctccgagcgcgacgcggatccggagccggacaaggctccgcggcgcttaaccaagaggcgcttcccggggctgcggctctttgggcacaggaaagccatcaccaagtcgggcctccagcacctggcaccccctcctcccacgcctggggccccgtgcggtgaatctgagcggcagatccggagtactgtggactggagtgagtcagcagcgtatggggagcacatctggtttgagaccaacgtgtccggagatttctgctatgtcggggagcagtactgtgtagctaagatgctgccgaagtcagcgcccagaagaaagtgtgcagcctgtaagatcgtggtgcataccccttgcatcgggcagctggaaaagatcaatttccgctgtaagccatccttccgtgaatcaggctccaggaatgtccgtgagccaaccttcgtaagacaccactgggtccacaggcgacgccaggatggcaagtgtcggcactgtgggaagggcttccagcagaagttcaccttccacagcaaagagatcgtagctatcagctgttcctggtgcaaacaggcgtaccacagcaaggtgtcctgcttcatgctgcagcagattgaggagccctgttccctaggggtgcatgcagccgtggtcatcccacccacctggatcctacgggcccggaggccccagaacaccctcaaggccagcaagaagaaaaagagagcatccttcaaaaggagatccagtaagaaaggacctgaggaaggccgctggagacccttcatcatcaggcccaccccgtcccccctcatgaagcccctgctagtgtttgtaaaccccaagagtgggggtaaccagggcgctaagatcatccagtcttttctgtggtatctgaacccccggcaagtcttcgatctgagccagggaggacccagggaagcgctggaaatgtaccgcaaagtccataatttgaggattctggcttgcgggggtgatggcacggttggctggattctttccaccctagaccagctgcgcttaaaaccaccacctcctgtggccatcctgcccctgggcactggcaatgacctggcccgaactctcaactggggtgggggttacacagatgagccagtgtcaaagatcctttcccatgtagaggaggggaacgtggtacagctggaccgttgggacctccgagcagagcccaaccctgaggcagggcctgaggagcgagatgacggagccactgaccggctgcccctggatgtcttcaacaactacttcagtctgggctttgatgcccacgtcaccctggagtttcatgagtctcgagaagccaacccagagaagttcaacagccgctttcggaataagatgttctatgctgggacagccttctctgacttcctgatgggcagctccaaggacttagccaagcacatccgagtagtgtgtgacggaatggacctaacccccaagattcaggacctgaaaccgcagtgcatagtctttctgaatatccccaggtactgtgcaggcaccatgccctggggccaccctggggagcaccatgacttcgagccccagaggcacgatgatggctacctcgaggtcatcggcttcaccatgacatccttggccgcattgcaggtgggtggacacggcgagcggctgacccagtgccgagaagtgctgctcaccactgccaaggccatccctgtgcaggtggatggtgaaccctgcaagcttgcagcatcgcggattcgaattgccctgcgcaaccaggccactatggtgcagaaggccaagcgccggagtactgccccactgcacagcgatcagcagccagttcctgagcagctgaggatccaagtgagcagggtcagcatgcacgactacgaggctctccattatgacaaggagcagctcaaggaggcctctgtgcctctgggtactgtggtggtccccggagacagtgacctagagctctgccgagcccacattgagagactccagcaggagcccgatggggctggagccaagtcccccatgtgccacccactgtcctccaagtggtgtttcctggacgccaccactgccagccgcttctacaggatcgacagggcccaggagcacctcaactatgtgacggagattgcccaggatgagatttatatcctagacccagagctgctgggtgcatcagcccgacctgacctccctacccctacctccccgctccctgcctccccctgctcccctacacccgggtcactgcagggggatgccgcactgccccaaggtgaagagctgattgaagctgccaagaggaatgacttctgcaagctccaggaactacaccgagcaggaggtgacctcatgcaccgcgaccatcagagccgcacactcctgcaccacgcagtcagcactggcagtaaggaagtggtccgctatctgctcgatcatgcaccaccagagatcctcgatgctgtggaggagaacggggagacctgtctacaccaggcagccgccctaggtcagcgcaccatctgccactacattgtggaagccggggcctccctcatgaagacagatcagcagggcgacactcccaggcagcgagctgagaaggctcaagacacagagctagctgcatacctggagaacagacaacattaccagatgatccaacgtgaggaccaggagacagctgtgtagttaaggggaccatggatcaacgagggacactaccagaggactagagctctccttgcccatctcactgccacattcctgtcagatggctatggggggaccctgtcacagggaaggagccccgtgccaccccctgagaagccgttcagatctagggctggactctaaggagctggactctcacctgtccctggtttcatggggaacaggaaacaagctgggctgactgggtccctcccttcaggcggcctccccctcaccacagctgatggaatggctggacagctcagtcagggaggcctgctctcagcaggactttctaaagccacctgatcccttgggctctttggaaggttctgggtgcctagccctcctctctgacccacacaccttgggcatcccagaaactcaagagcctgctgtatttgcctgcccgctgccctgcttggcacctaccctggtgatcctcctcatgcacccagtcatttcatttccgactgtatggcctggggtggggggtggggctcccacggtgacttgtttacagctgggtgtgactcagtaaagtgaagtttttttccttaaaaaaagcg

SEQ ID NO: 2261 - DNA, 1128 bp, Rattus norvegicus
  Genbank Accession No. NM_031144
atggatgacgatatcgctgcgctcgtcgtcgacaacggctccggcatgtgcaaggccggcttcgcgggcgacgatgctccccgggccgtcttcccctccatcgtgggccgccctaggcaccagggtgtgatggtgggtatgggtcagaaggactcctacgtgggcgacgaggcccagagcaagagaggcatcctgaccctgaagtaccccattgaacacggcattgtaaccaactgggacgatatggagaagatttggcaccacactttctacaatgagctgcgtgtggcccctgaggagcaccctgtgctgctcaccgaggcccctctgaaccctaaggccaaccgtgaaaagatgacccagatcatgtttgagaccttcaacaccccagccatgtacgtagccatccaggctgtgttgtccctgtatgcctctggtcgtaccactggcattgtgatggactccggagacggggtcacccacactgtgcccatctatgagggttacgcgctccctcatgccatcctgcgtctggacctggctggccgggacctgacagactacctcatgaagatcctgaccgagcgtggctacagcttcaccaccacagctgagagggaaatcgtgcgtgacattaaagagaagctgtgctatgttgccctagacttcgagcaagagatggccactgccgcatcctcttcctccctggagaagagctatgagctgcctgacggtcaggtcatcactatcggcaatgagcggttccgatgccccgaggctctcttccagccttccttcctgggtatggaatcctgtggcatccatgaaactacattcaattccatcatgaagtgtgacgttgacatccgtaaagacctctatgccaacacagtgctgtctggtggcaccaccatgtacccaggcatcgctgacaggatgcagaaggagattactgccctggctcctagcaccatgaagatcaagatcattgctcctcctgagcgcaagtactctgtgtggattggtggctctatcctggcctcactgtccaccttccagcagatgtggatcagcaagcaggagtacgatgagtccggcccctccatcgtgcaccgcaaatgcttctag

SEQ ID NO: 2262 - DNA, 822 bp, Rattus norvegicus
  Genbank Accession No. NM_031145
ccacgcgtccggttggccgagctgtgcgcgcaccgcggcgatgggaggttcgggcagtcgcctgtctaaggagctgctggccgagtaccaggacctgacgttcctgaccaagcaggagatcctccttgcccacagacgcttttgcgagttgcttcccccagagcatcggaccgtggaagagtcactgcatacccgagtatcttttgagcagatcctcagccttccagagctcaaggccaaccccttcaaggagcgaatctgcatggtcttctccacgtcgcctaccagagacagcctgagctttgaggacttcctggacctcctgagtgtcttcagtgacacagcaaccccagacatcaagtcacactatgccttccgcatctttgactttgatgatgatggaaccctggacagagaagacctgagccggcttgtgaactgcctcacgggagagggcgaggacactcggctcagtgcttctgagatgaagcagctcatcgacaatatcctggaagagtcggacattgacagggatgggaccatcaatctctccgagttccagcacgtcatctctcgctcaccagactttgccagctcctttaagattgtcctgtgatggctttcaagtaccaacatcctgtccaagacctttccactgctgagatgtggccaaggttatgcctgcggtgtcagggccagagccggcccagcctggagagggcgctgcagagtctggccccctggcaggggaggactctcccccttgtcactgctgttgccatcactgtttttactaattggtaataaaggtttagaaatgtt

SEQ ID NO: 2263 - DNA, 1288 bp, Rattus norvegicus
  Genbank Accession No. NM_031149
gccgaaagagggaagatggcgcttgatgggccagagcagatggaactggaagaggggaaggcaggcagtggactccgtcaatattatctgtccaagattgaagaactccagttgattgtgaatgacaagagtcagaacctccggagactgcaggcccagaggaatgagctcaatgcaaaagttcgtctgttgcgggaggaactgcagctgctgcaggaacagggctcctacgttggagaagtcgtgagggccatggataagaaaaaagtgttggtcaaggtccatcctgagggcaaatttgttgttgatgtggacaagaacattgatatcaatgatgtgacacccaattgtcgggtggctctaagaaatgacagctacactctgcataagatcctgcctaacaaagtggaccctttggtatcactaatgatggtggaaaaggtgccagactcaacctacgagatgattggcgggctagacaagcagatcaaggagatcaaagaagtgattgagctgcctgtgaagcaccctgagctctttgaagccctgggcattgcacagccaaagggagtcctgctatatggacccccgggcactgggaagacgttgttggcccgggctgtggctcatcatacggactgtacctttattcgtgtctctggctctgaactggtacagaaattcattggggaaggggcaagaatggtgagggagctgtttgtcatggcccgagaacatgctccctccatcatcttcatggacgagatcgactctatcggttcttcacggctggagggaggctctggaggcgacagtgaggtacagcgcacaatgctggaactgctcaaccagctggatggctttgaggccactaagaatatcaaggttatcatggctactaataggattgatatcctggactctgccctgcttcgtcctgggaggattgacaggaaaattgaattcccacctcccaatgaggaggcccggctggacattttgaaaatccactctcggaaaatgaacttgaccagggggatcaacctgaggaaaattgctgagttgatgccaggagcttcaggggctgaagtgaagggcgtgtgcacagaggccggcatgtatgctctgcgggaacggcgtgtccacgttactcaggaggactttgagatggcagtagccaaggtcatgcaaaaggatagtgagaaaaacatgtccatcaagaagctttggaagtgagggtgtgtcctttgtgtggatccctcaaataaaggtctgtgcgataaactcc

SEQ ID NO: 2264 - DNA, 895 bp, Rattus norvegicus
  Genbank Accession No. NM_031152
atgggcacccgcgacgacgagtacgactacctctttaaagttgtccttattggagattctggtgttgggaagagtaacctcctgtctcgatttactcggaatgagtttaatctggaaagcaagagtaccattggagtagaatttgcaacaagaagcatccaggttgatgggaaaacaataaaggcacagatatgggacacagcagggcaggagcggtacagggctataacgtctgcatactatcgtggagcagtaggtgccttattggtttatgacattgctaagcatctcacatatgaaaatgtagaacgatggctgaaagaactgagagatcatgctgatagtaacattgttatcatgcttgtgggcaataagagtgatttacgtcatctcagggcagttcctacagatgaagcaagagcatttgcagagaagaatggtttgtcgttcattgagacatctgctctagattctacaaatgttgaagctgcttttcagacaattctaacagagatataccgcattgtttctcagaagcaaatgtcagacagacgtgaaaatgacatgtctccaagcaacaatgtggttcctattcatgtcccacccaccactgagaacaagccaaaggtgcagtgctgtcagaacatctaaggcgcctctctcccctagacggctgtgtatagtccatttcccaggtctgagatttaaatatatttgtaattcttgtggtcactttctgtgttttattacttccttacacttaagaatcttcccatgtcttaagtctttgatttggctttataaaatcctcaactttgtcctgaatgactcgagttctttttcatgctatggcttctctagccttagtttaataaactgaatgtttgaagtcctc

SEQ ID NO: 2265 - DNA, 1208 bp, Rattus norvegicus
  Genbank Accession No. NM_031154
cgttcagaccccagcaccatgcccatgacactgggttactgggacatccgtgggctagcgcatgccatccgcctgctcctggaatacacagactcgagctatgaggagaagagatacaccatgggagacgctcccgactttgacagaagccagtggctgaatgagaagttcaaactgggcctggacttccccaatctgccctacttaattgatgggtcacacaagatcacccagagcaatgccatcctgcgctatcttggccgcaagcacaacctgtgtggggagacagaagaggagaggattcgtgtggacattctggagaatcagctcatggacaaccgcatggtgctggcgagactttgctataaccctgactttgagaagctgaagccagggtacctggagcaactgcctggaatgatgcggctttactccgagttcctgggcaagcggccatggtttgcaggggacaagatcacctttgtggatttcattgcttacgatgttcttgagaggaaccaagtgtttgaggccacgtgcctggacgcgttcccaaacctgaaggatttcatagcgcgctttgagggcctgaagaagatctccgactacatgaagtccagccgcttcctcccaagacctctgttcacaaagatggctatttggggcagcaagtaggaccctgacagggtggctttaggagaaagataccaaatctcctgggtttgccaagagccctaaggagcgggcaggattcctgagccccagagccatgttttcttccttccttccattccagtccccaagccttaccagctctcattttttggtcatcaattcctgccaaacacaggctcttaaaagccctagcaactcctttccattagcaaaatagccttctaaagttaaagtgccccgcccccacccctcgagctcatgtgattggatagttggctcccaacatgtgattattttgggcaggtgcaggctccccggcagatggggtctatctggagacagtagattgctagcagctttgaccaccgtagccaagcccctcttcttgctgtttcctgagactagctatgagcaaggtgtgctgtgtccccagcacttgtcactgcctctgtaacccgctcctaccgctctttcttcctgctgctgtgagctgtacctcctgaccacaaaccagaataaatcattctcccctt

SEQ ID NO: 2266 - DNA, 1531 bp, Rattus norvegicus
  Genbank Accession No. NM_031237
ctctgggcgaagcgcggatataagtagctggtggctctgccaccccaccctgcccggatcgcgacggttttcagggttctggaatcagcagggttcctctgaggccttggcgagtggctgatctgctccgtttttgcaaaaggcgcctgtgtctggcagagccggtgtgagaagaagagagaatccttccccgccgccgggataatcaagagttttggccggacctttgagtacacatcgggatagtgagaagcccggcgaaaagcacagactatggcgctgaaacggattaataaggaacttagtgatttggcccgtgaccctccagcacaatgttctgcaggtccagttggagatgacatgtttcattggcaagccacaattatgggacctaatgacagcccatatcaaggtggtgtattctttttgacaattcattttcctacagactaccccttcaaaccacctaaggttgcatttacaacaagaatttatcatccaaatattaacagtaatggcagcatttgtcttgatattctaagatcacagtggtctcctgctttaactatttctaaagttcttttatccatttgttcactgctatgtgatccaaacccagatgaccccctagtgccagagattgcacggatctataaaacagacagagacaagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttccctccctccattcattcacatgctcatctgagaagacctaagttcttccagctttggacaataactgcttttagaaactgtaaagtagttacaagagaacagttgcccaagattcagaaatttttttaaaactggagcatgtgtattatgtggccaatgtcttcactctaacttggttatgagactaaaccaatcctcactgctctaacatgctgaagaagccatctgagggggagggggatggatgctgagctgtcacatcaaaggaaacagcattattccagcagcatccattcttgtctaaaccttccactgttagagatttgaggttacatgatatactttatgctcataactgatgtggctggagaattggtattgaattatagcatcagcagaacagaaaatgtgatgtattttatgcatgtcaataaaggaatgacctgttcttgttctacagagaatggaaattggaagtcaaacaccctttgtattccaaaatagggtctcaaaacattttgtaattttcatttaaattgttaggcttggagctattagttaatctatcttccaatactgtttaatatagcactgaataaatgatgcgagttgtcaatggatgagtgatcaactaatagctctcctagtaattgatttatttttcttcaataaagttgcataaacc

SEQ ID NO: 2267 - DNA, 2318 bp, Rattus norvegicus
  Genbank Accession No. NM_031325
ggagcggcgggcggagaggtgtgtggagcttgtggcttgggaggaaggcgctgtccgagagaacgtgatctgcgcggccgctgtgtcctggccttggaagtggttcagtcatggttgagatcaagaagatctgttgcattggtgcgggctacgtcggcggacccacatgcagtgtcattgctcgcatgtgccctgaaatcagggtaacggttgtggatgtcaatgaggccaggatcaatgcatggaattctccaacgcttcctatttatgagcctggactaaaagaagtagtcgaatcctgtcgagggaaaaacctctttttttctaccaatattgatgatgccatcagagaagccgatctagtgtttatttctgtgaacacaccaacaaaaacatatggaatgggaaaaggccgggcggcagatctgaagtatatcgaagcttgtgctcgccgcattgtgcagaactcaaatgggtacaaaattgtgactgagaaaagcacagtccctgtgcgggcagcggaaagcatccgccgcatatttgatgccaacacaaagcccaacttgaatctacaggttctgtccaatcctgagttcttggcagagggaacagccatcaaggacctaaagaacccagacagagtcctgattggaggggatgagaccccagagggccagagagctgttcaggcactctgtgctgtgtacgagcactgggttcccaaggaaaagatcctcaccaccaacacttggtcctcagagctttccaaactggcagccaatgcttttcttgcccagaggatcagcagcattaactccataagtgctctgtgtgaaagcacaggcgccgatgtggaagaggtggcaacggctatcgggatggaccaaagaattggaaataagtttctaaaagccagcgttggttttggtgggggctgcttccaaaaagatgttctgaatttggtttatctctgtgaggctctgaatctgcccgaagtagctcgttactggcagcaggtcatagacatgaatgactaccagaggaggaggtttgcatcacggatcatagacagcctgtttaatacagtgactgataagaagatagctatcttggggtttgcgttcaaaaaggatactggtgataccagggagtcctccagtatctacattagcaaatacctgatggacgagggtgcgcacctccacatctacgaccccaaagtacccagggagcagatagtggtggatctttctcatccaggcgtctcagcggatgaccaagtgtccagactggtgaccatttccaaggatccatatgaagcatgtgatggcgcccatgccctcgttatctgcacagagtgggacatgtttaaggaactggattatgaacggattcataaaagaatgctgaagccagccttcatatttgatggccggcgtgtcctggatgggctccacaatgagctacagaccattggcttccagattgaaacaattggcaaaaaggtatcttccaagagaattccatacactcctggtgaaattccaaagtttagtcttcaggatccacctaacaagaagcccaaagtctagacgtcgcccttttgcctgtgatgatttggtactgcagggtagccagcgtctgtctgatactaagtggtaaatgaactacgtgtttttatggaaacaaaaatatttttgtaatcatcaaatttatactagctatctgggtgttagcatatctagtaattatgagtctagaataatttttatatatttttatattattgtactctcagttactgaatggatggaaaacaatcatgttggtttaaatgtcagtttttataaataaaaatgaaaccttgaattttttagcattacaggttgttacagactgcactgtaataacacaagggaaaggcagtctcatttccctacctgttgtctctgcttatcactaaatgggacttcgaagccgtgaaatcactgtgctaggatggctgatgaaggtctctggacttttgttttaatgagattatgtcattagtggttttagttgtctttgtgtctcccaaaaccactctgtctttctctccatgcgtaactcgggcagtgctttcttttttgaaaattcagcctgaggaggaaatcagtctatggtctagttcgtcctgcctcttagcttctgtacctgcttgtcacatttgcacctatgagtcaagatatgtttgttacctttattttgatttatttctattacaattcaatttttttcctttaattaagaaaaccaataaagtctcatgtgtaaactgg

SEQ ID NO: 2268 - DNA, 1871 bp, Rattus norvegicus
  Genbank Accession No. NM_031327
ttgttggttctgtgtcgccgcgctcgccccggctcctcctgcgcgccacaatgagctccagcaccatcaagacgctcgctgtcgccgtcacccttctccacttgaccaggctggcactctccacctgccctgcctcctgccactgccctctggaggcgcccaagtgcgccccgggagtcggcttggtccgggacggctgcggctgctgtaaggtctgcgcgaagcaactcaacgaggactgcagcaaaacgcaaccctgcgaccacaccaaggggctggaatgcaatttcggcgccaattccaccgctctgaaagggatctgcagagctcagtcagaaggcagaccttgtgaatataactccaggatctaccagaacggggagagcttccaacccaactgtaaacatcagtgcacatgtattgacggtgctgtgggctgcattcctctgtgtccccaagaactgtctctccccaatctgggctgtcccaacccccggctggtgaaagtcagcgggcagtgctgtgaggaatgggtctgtgatgaagacagcattaaggactccctggacgaccaggacgacctccttggattcgatgcctcggaggtggagttaacaagaaacaatgagttaatcgcaactggcaaaggcagctcactgaagaggcttcctgtctttggcacggaacctcgagtcctttacaaccccctgcatgcccatggccagaaatgcatcgttcagactacgtcctggtcccagtgctccaagagctgcggaactggcatctccacacgagttaccaatgacaacccggagtgccgcctggtgaaagagacccggatctgtgaagtgcgtccttgtggacaaccagtgtacagcagcctaaaaaagggcaagaaatgcagcaagaccaagaaatccccagaaccagtccgatttacttatgcaggatgctccagtgtgaagaaataccggcccaaatactgcggctcctgcgtggacggccggtgctgcacacctctgcagaccaggaccgtgaagatgcggttccggtgcgaagatggcgagatgttctccaagaacgtcatgatgattcagtcctgcaagtgtaactacaactgcccgcatcccaacgaggcgtcgtttcgcctctacagtctgttcaacgatatccacaagttcagggactaaaggtctcctgggtttctagtgtgggtcggacagaggtgttgagcatcgtggagacgtgggcagacggtgggcgaacagtgccttgctcatcatcaagtaggattaaggtgtttcaaaactgccgtaggggctgctgctatggatggacagtaacgcagtcgcagttggagaatacttcgcttcatagtactggagcccgggttacgtacgcttcatattggagcatgtttatagatgatgttctgttttctgtttgtaaattattttgctaagtgtttttttttctttctttttttttttttttttttgctccatttctccccctccccccttggttctacaattgtaatagagataaaataagactagttgggtcaagtgaaagccccgcttgtcctttgacagaagtaaaatgaaaggcctctcctgccttccccagtggaggcaggggacactctgtgagtgcccttgaggctactacctgcactctaaactgcaaacagaaaccaggtgttctaagattgaatgtttttatttatcaaaatgtagctttcggggagggatggggaaatgtaatactggaataatttgtaaatgattttaattttatatcagtgaagagaatttatttataaaattaatcatttaataaagaaatatttacctaaaaaaaaaaaaaaa

SEQ ID NO: 2269 - DNA, 3061 bp, Rattus norvegicus
  Genbank Accession No. NM_031330
tgtgaccgcggccaagcccgctcgccttctgcggcgagtagggcctcgcggcgtcatcggcggcgaggagccgctgcggcctggccgaccatgtcggacgcggctgaggagcagcccatggagacgacgggcgccaccgagaacggacacgaggccgcccccgaaggcgaggccccggtcgagcctagccctggcagcggccccgcgactccggcggggtctgtgggcgggaccacggccgccccgagcgggaaccagaacggcgccgaaggcgaccagatcaacgccagcaagaacgaggaggacgcgggaaaaatgttcgttggtggtctgagctgggataccagcaaaaaagatctaaaggattattttactaagtttggagaggtcgttgactgtacaataaaaatggatccgaacactggtcgatcaagagggtttgggtttattctcttcaaagattcttctagtgtggagaaggtcttagatcagaaggagcacagactggatggtcgtgtcattgaccctaaaaaggctatggctatgaagaaggaccctgtgaagaaaatctttgtgggaggtctaaaccctgaagccacagaggaaaagatcagagaatactttggccagtttggggagattgaggccattgaacttccaatagatcccaagttgaacaaaagacggggttttgtttttattacatttaaagaggaagaccctgtgaagaaagttctggagaaaaaattccatactgtcagtggtagcaagtgtgaaatcaaggttgcccagcccaaagaggtgtaccagcaacagcagtatggctctgggggccgaggaaatcgcaatcgagggaaccgaggcagtggtggaggtcagagtcagagttggaatcagggctacggcaactactggaaccagggctacggctaccagcagggctacgggccgggctatggcggctacgactactcgccctatggctattacggctacggccccggctacgactacagtcagggtagtacaaattacgggaagagccagcgacgtggtggtcatcagaataactacaagccatactgagaggcagcaggagcggccgagtgacgacgcacacgctttgtttggacgcggagtgaacacaattatgtaccaaatttaacttggcaaacttttatggcctgtcccatgtgcatcttatttaaaatttcccccggaaatcactctcctgtttactattccagagctctagttgttgtaggcagcgtgtggcgtctcagaggtcagagcggcattagggggctgattttattaccaggttaccctgttctagattggagggtctgcttcctgctgccgctctgcagcctggacctgtggaccctggttgtaaagagtaaactgtatcttaggaaaccagtgtcacctttttcaccttttaattttatattatttgtgtcatacatttccagtaatggaagtgttaattttactgtactttttggtaccttttgggaatctaatgtattgtaaggtattttacacgtgtcctgattttgccacgacctggatattgaagctatccaagcttttgaaataaaaatccctgagagtctggtccactaactccagggactgtgggacagaggaacaaacaagaaagaactcgaggcctcgctgagtggcacgcttgctgagtgctgccacatcccgcaagctgagcaggtatcccaactctgttcctgcccggtagaccacccgaggtgtgagtgtggtcttgtcttccagattcgtaggacagaagctccaggaggaggacccgcccaacatggcatcggagagcgggaagctatggggtggccgatttgcaggctcggtcgaccccaccatggacaagttcaactcatctatcgcctatgaccggcatctgtggaatgtggacctgcagggaagcaaggcctacagcaggggcctggagaaggcagggcttcttcaccaaagctgagatgcagcagatactgcaaggcctggacaaggtggctgaagagtgggcccaaggcatcttcaaattgtaccctaatgatgaagacatccaccttcctcaaggtgctcattgaagccatggtagaccgggcagaggcggagtgtgaagtcctcttccctgggtacacacacttgcagagagctcagcccatccgctggagccactggatcctgagtcacgccgttgcgctgacacgagatttagagagactgaaggaggtgcagaagcggatcaatgtcctgccactgggcagtggggccattgcaggcaaccctctaggtgtggaccgggagttcctctgtgcagaactgaactttggagccattacgctcaacagtatggatgccaccagcgagagagacttcgtggctgagttcctgttttgggcttctctgtgcatgacccatctcagcaggatggcagaagacctgattctctacggtaccaaggaattcaactttgtgcagctctccgatgcctacagcaccggaagcagcttgatgccccagaagaaaaacccagacagcttggagctgatccggagcaaggcgggccgagtgtttgaagtgtctgataccatgacagctgtcctccaagtagccactggagtcatctctacactgcagattcatcgtgagaacatggcacaggcactcagccctgacatgctggctaccgaccttgcctactacctggtccgcaaagggatgccattccgccagcccacgaggcctcagggaaagctgtggtcgtggcagagatgaaaggggtggctctcaaccagctgtcacttcaggagatgcagaccgtcagtcccctgttctcgagtgacgtgaatctcgtgtgggactacagccacagcgtggagcagtacacagccttgggtggcacagcacagtccagtgttgagtggcagatcagccaggtgcgggccctgctgcagatgtagcagccctagattccacccagtcaaagctgcgccccaataaagtggagccctggagaggccgccat

SEQ ID NO: 2270 - DNA, 1818 bp, Rattus norvegicus
  Genbank Accession No. NM_031353
cccagcctcctcgccgcaacccccgccgtagctgccgctgctcccgccgtcaccgcctccgagaacatggctgtgcctcccacatatgctgatcttggcaagtccgccagggatgtcttcaccaagggctacggctttggcttaataaaacttgatttgaaaacgaagtccgagaatggattggaatttactagctcaggttctgccaacacggagaccaccaaagtgaacggcagtctggaaaccaagtacagatggaccgagtatgggctgacgtttactgagaagtggaacacagacaacaccctgggcactgagatcaccgtggaagaccagcttgctcgtggactgaagctgacctttgattcatctttctcgcctaacactgggaaaaaaaatgctaaaatcaagacagggtacaagagggagcatatcaacctgggctgtgatgtggactttgacatcgctgggccctcaatccggggcgctctggtgcttggctatgagggttggctggctggctaccagatgaattttgagacctcgaagtcccgagtgacccagagcaactttgcagttggctacaagacggacgaattccagcttcatactaatgtgaatgatgggacggagtttggtggctccatttaccagaaggtgaacaagaagttggagactgctgtcaatctcgcctggaccgcaggaaacagtaacactcgctttggaatagcagccaagtatcaggtcgaccctgatgcctgcttttcggccaaagtgaacaactccagtctaattggcttagggtacactcagaccctaaaaccaggtatcaaactgacactgtcagccctgctggatggcaagaacgtcaatgcgggtggccacaagcttggtttaggactggaatttcaagcataaatgaatattgtacaatcgttaattttaaactattttgcagcatagctaccttcagagtttagtgtaccttttaatgtcatatgttggggatgcgagagttgattgataccacgttagacctccaggctaaggatgactcggctttaaggtgtttaccgtttcagaggtacagcggaaaccccattccaggaagggtcctttttagctgtaggcgtgggctgggaggagctcctctagagatgccaggctgcaagtggaagctgggaacgtgtggaccctttgtaaatctgtatccagttccgcacatgaaattgtgacttcctgaacatcgaaccccggtgtcccgatcctgtctgctcggaagcatgtacacacctacgtgaaagggacggttttttttttttttttatcggatggtcacgcccggttcccatcgtgccctgttcccatcctagcccatcagttacctgttttacaccaaaagtagtctttagggtgtagttagcaatttcttttgtgccattttagggtggagagggtgggcatgatgaagccagtcattcaggacttaattcttccttgtgttgtggtgtggttttcttcctttcttctgtttttttttttttaattccttttttttttgccattgcaccagagtatgaaatagcttccaggttgtccggctcagagctgggcgggtgattgtggtcacaccctgacaacactagggatctcaacggactcctcttgtagccgcaccactatttttagcagtttaatgggtacattatagagtcttccattttgtgtggaattagctcctccccttcaaatgctgtaattaacatcacttaaaataaaacttgaataaaatactgaaacctcaaaaaaaaaaaaaaa

SEQ ID NO: 2271 - DNA, 1715 bp, Rattus norvegicus
  Genbank Accession No. NM_031354
ggggaggccaggcttgcggcggggcgcaacggtgtctccttcacttcgccctccagccgcggtggctgcagcgcaacttccagatagcggagtggcctcagctgcgagccgagcggtggcggcagcgcccctcaggacacccgcagatcaccttttccccgcgacttcgccatggctgaatgttgtgtaccggtatgccaacggccaatttgtatccctccaccctatgctgaccttggcaaagctgccagagatattttcaacaaaggatttggttttgggttggtaaagctggatgtgaaaacgaagtcatgcagtggtgtggaattttcaacatctggctcatctaatacagacactggtaaagtcagtgggaccttggagaccaagtacaaatggtgtgagtatggtctgactttcacagagaaatggaacactgacaacactctggggacggagattgcaattgaagaccagatttgtcaaggtttgaaactgacctttgacaccacgttttcaccaaacacaggaaagaaaagtggtaaaatcaagtctgcttacaagagggaatgtataaaccttggctgtgatgttgattttgattttgctggacctgccatccatgggtcagccgtctttggttacgagggctggcttgctgggtaccagatgacctttgacagtgccaagtcaaagctgacaaggagtaacttcgcagttggctacaggactggggacttccagctacacacaaatgtaaataatgggacagaatttggaggatcaatttatcagaaagtatgtgaagattttgacacttcagtaaaccttgcttggacatcaggtaccaactgcactcgttttggcattgcagctaaataccagttggaccccactgcttctatttctgcaaaggtcaacaactctagtttaattggagtgggctatactcagactctgaggcctggtgtgaagcttacactgtctgctctggtagacgggaagagctttaatgctggaggccacaaacttgggcttgccttggaattggaggcttaatccagttaaaagaaacctctgggaacggatatcagaagatttggccttaatatatttccatgcgaccagcaggctccccctcccccccagaaggtgatcacatcaaaggatgattaagcaagagcgtgttttaaatatttagacagtcacccgttggctggtttctagttggatggttatctcgttatcagtgctgccgtcgtgcggcctcctctacattatttaatgtacttaactgttaaatgtgctacccaccaatgatgaaatagacgtttatgaaaaccgtgccatggtgtgcatgtttgttttatgttccttttacccttgactcttgtactgaatgagatggatcagtggatgttttaagatgaggatgaagatcttttttgtgatattcacccatcactagaatcactttggtaaccccaaacatgacaaattatgaataaaacgagtgtacacaactaatgcctcacgtatgtgcagtcagattgcagcctaggggctaatcttcttggtaaatacttctggtgagcactttgctctttaccgaaacttgggcaaccaaactccctgtgtccctagcataatcaatccacgaggtctttgagactacaataaaatacaaggatacatgctttaaaaaaaaaaaaaaa

SEQ ID NO: 2272 - DNA, 2485 bp, Rattus norvegicus
  Genbank Accession No. NM_031357
ccaaaatgggactccaagcccgcttcctaggactccttgctctcgtcatcgccggcaaatgcactcacagccccgagccggaccaacggtggatgctgcctccaggctgggtgtcactgggccgagtggatcccgaggaagagctgagtcttacttttgcgctgaaacagcagaacctggacagactctcggagctggtgcaggctgtgtcggatcccagctctcctcgatatggaaagtacctcaccctagaggatgtagctgagctggtccaaccatcaccactgaccctccgcactgtccaaaagtggctcttggcagctggagcccgggactgccattcagtgaccacccaggactttctgacttgctggctgagtgtccggcaggctgagctgctgcttcctggggctgagtttcatcgctatgtagggggacctgcaaagacccacattataaggtccccacatccctatcagctcccccaggccttggcccctcatgtggaccttgtggcggggctgcaccgtttcccccctttatcatctccgagacaacgtccagagccacaaggagtgggacctgttggcctgcacctgggagtgactccatctgtgcttcgtcagcgatataacctgacagcccgagatgtgggctctggcaccaccaacaatagccaggcctgtgcccagttcctggaacagtacttccataactcggatctgactgagttcatgcgcctgtttggtagcagttttgcacaccaggcctcagtagcaagagtggttggaaagcaggggcgaggccgagcgggcatcgaggccagtctagatgtggaatacctgatgagtgctggtgccaatatctccacttgggtctacagtagccctggccgccatgaggcacaggagcccttcttacaatggctcctgcttcttagcaatgagtcatccttgccgcatgtacatactgtgagttacggagacgatgaagactccctcagcagtgtctacatccagagagtcaacactgagttcatgaaggctgctgctcggggtctcaccctcctttttgcctcaggtgacactggagctgggtgttggtctgtctccggaagacacaagttccgtcctagcttccctgcttctagcccctatgtcactacagtaggaggaacctccttcaagaatcctttccttgtcacaaatgaagtagtcgactatatcagtggtggaggcttcagcaatgttttcccacagccttcataccaggaggaagcagtagcccagttcttgaagtccagctctcatctaccaccatctagttacttcaatgctagtggccgtgcttacccagatgttgccgcgctttctgatggctactgggtggtcagcaacatggtccccattccgtgggtatctggaacctcggcctctactccagtgtttgggggaattttatccttgataaatgagcacagactcctcaatggccgcccccctctaggctttctcaatcccaggctctatcagcagcatggggcaggactctttgatgtaacccatggctgccatgagtcctgtctgaatgaagaagtggagggtcagggtttctgctctggtcctggctgggatcctgtgacaggttggggaacacccaacttcccagccctactgaagactctactcaacccttgacccttccctgccctgacgagaaagcagaactgtttcctgtactacaagggaaggctcagtttctcgttattcctcaatggaagccctgatgaactcttaactgttgcctgctgcagatagcttctccctaaccctcaaatgctgtgagcaggactggactcccaaccctgtgagccatcaaactcaggtctccaaacttctacttcgagatccccaacaagatgctataaccagcattttgtctcaccccaaccccatctctccttcctctttccagcttgagatgtgaaagcagggcgagaagattcagtctgcattactgacaccagcagtcccacctaatgcttaccacctctgcactgaccgtatgctctttctcttccagctgcttcttcgttcactgaaatgagacctttgtgctaatcgtttagtctttcttcccctggcactgaagtgcaatggtctccctgacattctatccagttatacacttctcagtgttttatgggctttcttgtttaagaacaggttggtgatgggttggggatttagctcagtggtagagcgcttgcctaggaagcgcaaggccctgggttcggtccccagctccgaaaaaaagaaccaaaaaaaaaaaaagaacaggttggtgacaatctatataactattctaaggaaagttcaagtttgaaaattttaaatgttttaaatgttcttattggcaaagctcctcaacaaaataaataggtgttacaaattttgcttcaaaaaaaaaaaaaaaaaaaaaaaaa

SEQ ID NO: 2273 - DNA, 3305 bp, Rattus norvegicus
  Genbank Accession No. NM_031358
cgttgctgtcgatcctgctcagtacgagaggaaccgcaacgaacatttggtgtatgtgcttggctgaggagccaatggggcgacgtaccatctgtgggattatgactgaacgcctctaagtcagaatcccgcccaggcgaacgatacggcagcgcaaggagcctcggttggccccggatagccggctccccgtccgtccccgtccggcgggtccccgctcgtcgcccccccgggtgcgggcgggtcccccccgggcgtcgggaccggggtcggtgcggagagccattcgtcccgggaaacgggtgcggccggaaagggggccgccctctcgcccgtcacgcttaacgcacgttcgtgtggaacctggcgctaaaccattcgtagacgacctgcttctgggtcggggtttcgtacgtagcagagcagctccctcgctgcgatctattgaaagacaaacccttgcctacaaagagccctaggcaagccagtgtagtgcctccccatgggggaaaccccttcctggggccaacggagccatgctgtcccgaaaaggcattatccctgaggaatatgtgttgacccggctggcagaggaccctacagagcccaggtaccgtactcgggagaggagggcccgcttcgtgtccaagaaaggcaactgcaacgtcgcccacaagaacatccgagagcagggccgcttcctgcaagatgtgttcaccacgctggtggacctcaagtggccccacacgctgctcattttcaccatgtccttcctgtgcagctggctgctcttcgccatggtctggtggctcatcgcctttgcccacggtgacttggcccccggagagggcaccaatgtgccttgcgtcacaagcatccactccttttcgtctgccttccttttctccatcgaggtccaggtgaccattggtttcggcgggcgcatggtgacagaggaatgtcccctggccatccttattctgatcgtgcagaatatcgtagggctaatgatcaacgccatcatgctgggctgcatcttcatgaaaacggcacaggcccatcggcgggcagaaaccctcatcttcagcaagcatgccgtgatcaccctgcgacatggccgcctgtgcttcatgcttcgcgtaggggacctccgaaaaagcatgatcattagcgccaccattcatatgcaggtggtgcgcaagaccaccagcccggagggcgaggttgtgcctctccaccaggtggacatccccatggagaacggtgtgggtggtaacagcatctttctggtggccccactcatcatctaccacgtcatcgactccaacagcccgctctacgacctggctcctagtgacctgcaccaccaccaggacctggagatcattgtcatcttggaaggtgtggtagaaaccacaggcattaccacccaggcccgcacctcctatctggctgacgagattctgtgggggcagcgttttgtccccatcgtggccgaggaggatggccgctattctgtggactactccaaattcgggaacaccgttaaagtgcccacaccactctgcacagcccgccagcttgatgaggaccgcagcctgctggatgccctgaccctcgcctcgtcgcgagggcccctgcgcaagcgcagtgtggctgtggcaaaggccaagcccaagtttagcatctctccggattccttgtcctgagttgcggtccctcaggcccccactcacttaggtgggcacatggaaagtgaagtacggtatgtagagtgctggggtgcgagcccctcggccagatgagggtctggcgtgggacaagaccctccttggctcagcctccccgccgctgtgtgcctggggtgttacaagatacttgtcactatgctatttctggccccagcaggagcctgtaccgggttatttttgttcctgctcctcccgggctcagctcaggactggcttaccctatgtccctgcccaacgatggggaggctatagaaggttcaggggtcctaaagctaaggtctggaaggaagccagtcttggtcctccacgaattcatctgccacaagcaggcaggtaattgggcaaaagcagcccccaagttgggagcctattgctgtttctgtagccactaagaaatacctggccaggccccagccctgttcgtgccacgctaaagaatcctgccagccagggaggaggtgggtgtcagagcgtgggagctgaggggcccacacagccacgacaggataagtttacctaggctctcctccatatggccggcttatgagagaaagggggacaagaaggaggcaaatgattggagaccttgatggtcccgttcagacgcgtgtctctgtcctctacccttgactccagccttctgcagagagagtggggactgctgccctgttttgtcccccggagaggctgggaagtggggcattgggcaaacactgagatacctggctgagaggccgaaaagggtcctgtgagtgccatacaagatctacttcaggcaaaactctgctcttggctccccatgggcagctgtcactttgtctgggggacactggtgggtagcaatgccttgtctaggttgtcagaaaaagaaatattggaaagttcaccctggtgagggaaagggaggtctccaaggcaaaaggcccttgggcttgacctgagcccggactctcagagcagtgtagtgtcctcgcccagaaccccactggcccgtcgtcaataaagcctcccatctgtgacctgaactctgggcttttcttgctggggaggcagtgggcatgccactggggggaaaaggcactgtcagagtctgccacctagcatggcccggcagcaagaggccagaaaagctacttagactagctcctccgtttccctcacctcaggaggccatcatccttccacctcagttccaccccccccccactctcagtctgtctggccaactccaccatttgacatccaccagacatcatagtcaagggcctgggctgtctcctgactctgctggaaggctgaggtgcccatggggagggggagggaggctgtaggcctcaggggtattgattggctcaaatcctggctccagctgaaccaccctgtgacccggttgtctcgcccatgttaatagtccctacctcattaggttgagcaggtgaaaacacatgtatacttgcttcggaagtgcctggtctgtacacaagtgctcaataaatgtcaaccgtcgtgatcgctgctgagctagccatgtgatgggaaaactaaacctaagac

SEQ ID NO: 2274 - DNA, 1178 bp, Rattus norvegicus
  Genbank Accession No. NM_031509
acattaaccaactgtttagcaactcaggcatgactttgcatttttcttctaatctttcatagaaatttctggccactggacactgtgggagcagcttttaccttattggactatctccccttaagtgggaagggcttagtcaaatgcagtaaagagctataaaacaccgagaactcttgatgtgttgtgaaacttagagggagcagctttttaacaagagaactcaagcaattgctgccatgccggggaagccagtccttcactacttcgatggcagggggagaatggagcccatccggtggctcctggctgcagctggagtagagtttgaagaacaatttctgaaaactcgggatgacctggccaggctaaggaatgatgggagtttgatgttccagcaagtgcccatggtggagattgatgggatgaagctggtgcagaccagagccattctcaactacattgccaccaaatacaacctctatgggaaggacatgaaggagagagccctcatcgacatgtatgcagaaggagtggcggatctggatgaaatagttctccattacccttacattccccctggggagaaagaggcaagtcttgccaaaatcaaggacaaagcaaggaaccgttactttcctgcctttgaaaaggtgttgaagagccatggacaagattatctcgttggcaataggctgagcagggctgatgtttacctagttcaagttctctaccatgtggaagagctggaccccagcgctttggccaacttccctctgctgaaggccctgagaaccagagtcagcaacctccccacagtgaagaagtttcttcagcctggcagccagaggaagccattagaggatgagaaatgtgtagaatctgcagttaagatcttcagttaattcaggcatctatggatacactgtacccacaaagccagccttcgaaagctttgcaacaatcgcatattttgactaaatgttgaccctacttattgggaggccaacacgttttctaatgcttctgtgttaattcatatagacatgactgatgaggaattgctgggatgctatttggttgtagttaaaatttgaaatcatgatcacttcctcagatattactttgaatctcaataaaaacttcgcaagctttttaaaaaaaaaaaaaaaaaaaaa

SEQ ID NO: 2275 - DNA, 1719 bp, Rattus norvegicus
  Genbank Accession No. NM_031510
cgggtgtgagcggggttattgaagtaaaaatgtccagaaaaatccatggcggttctgtggtggaaatgcaaggagatgaaatgacacggatcatctgggaattgattaaagaaaagctcattcttccctacgtggaactggatctgcatagctatgacttaggcatagagaatcgggatgccaccaatgaccaggtcaccaaggatgctgcggaggctataaagaaatacaacgtcggcgtcaagtgtgctaccatcacccccgatgagaagagggttgaggagttcaagttgaaacaaatgtggaaatcacccaacggtaccatccggaacattctgggcggcactgtcttcagagaagctattatctgcaaaaatatcccccggctagtgacaggctgggtaaaacccatcatcattggccgacacgcctatggggaccaatacagagcaacagatttcgttgttcctgggcctggaaaagtagagataacctacacaccaaaagatgggtcgcagaaagtgacatacctggtgcatgactttgaagaaggtggtggtgttgccatgggtatgtacaaccaggataagtcaattgaagattttgcacacagttccttccaaatggctctgtcgaagggctggcctttgtatctaagcaccaagaacactattctgaagaagtatgatggacgcttcaaagacatcttccaggagatctatgacaagcaatacaagtccaagtttgaagctcagaagatctggtatgaacacaggctcatagatgacatggtggcccaggctatgaaatcagaaggaggcttcatctgggcctgtaagaactatgatggtgatgtgcagtcagactcagtagcccaaggttatggctcccttggcatgatgaccagtgtgctgatttgtccagatggtaagacggtagaagcagaggctgcccatggcactgtcacacgtcactaccgcatgtaccagaaaggacaggagacgtccaccaatcccattgcttccatttttgcctggtcccgagggttagcccacagagcaaagcttgacaacaatactgagctcagcttctttgcaaatgctttggaagaagtctgcattgagaccattgaggctggctttatgactaaggacttggctgcttgcattaaaggcttacccaatgtacagcgttctgactacttgaatacatttgagtttatggacaaacttggagaaaacttgaaggccaaactagctcaggccaaactttaaggtcaaacctgggcttagggcaaatctttgtggtaactaagtccacagtttacatatttcctttttgttttaataacactcaaggttaaaaacaagaatcattttgtaatttgtttagaagacgaagttgaacttttctatatgtttacagcctattttctttttcatacagttattgccaccttaatgaatgtggtggggaaggtttttttaattgtattttactgtgtaatagcagtctaggaattgtgttagtatctgttcacaattaactgtcactttttatttgctctaatgtaaatgaccaaaatcagaaatgctccaagggtgaacaatcactacactatgtttccccgtaaaggtgaaggagaggctcacctcccctactgtccatgagtgtgaacacagggagcaaaagtgtgcaaatgttgcactgtgtgtggaa

SEQ ID NO: 2276 - DNA, 3731 bp, Rattus norvegicus
  Genbank Accession No. NM_031514
atcctgcgcgcctccgggcgctcctgtgtggcccgacccgtgtcgccggttcctgaagcaggcgacgggaacaagatgtgaactgtttttcctccacagaagaagaggcccttctttcccctcccgggaaggccgatgttctgaaaaaggctgtggatgggaatggcttgccttacaatgacagaaatggagggaacctccacatctcctgcacatcagaatggtgatattcctggaaatgctaactctgtgaagcagacagagccagtccttcaagtgtacctgtaccattctcttgggcaagctgaaggagactatctgaagtttccaaatggagagtatgttgccgaagaaatttgtgtggctgcttctaaagcatgtggtattacgcctgtgtatcataatatgtttgctttaatgagtgaaacagaaaggatctggtatccacccaatcatgtcttccacatagatgagtcaaccaggcataatatactctacagaataaggttttactttcctcattggtactgcagtggcagcaacagaacctataggtacggagtatctcgtggggctgaagctcctctccttgacgactttgtcatgtcttacctttttgctcagtggcggcatgattttgttcatgggtggataaaagtacctgtgactcacgaaactcaggaagaatgtcttggcatggcagtgttagacatgatgagaatagctaaggagaaggaccagactcccctggctgtctataactccatcagctacaagacgttcttaccgaagtgcgtgcgagcgaagatccaggactatcacattttaactcggaagcggataaggtacagattccgcaggttcattcagcagttcagtcagtgcaaagccactgccaggaacctaaaacttaagtatctcataaacctggagaccctgcagtctgccttctacacagaacagtttgaagtaaaagaatctgcaagaggtccttcaggtgaggagatttttgcaaccattataataactggaaacggtggaattcagtggtcaagagggaaacataaggaaagtgagacactgacagaacaggatttacagttgtattgtgattttcctgatattattgatgtcagtattaagcaagcaaatcaggaatgctcaactgaaagtagagttgtgaccgtccacaagcaggacgggaaggtcttggaaatagaacttagctcattaaaagaagccttgtcatttgtgtcgttaattgacgggtattacagactaactgcggatgcacaccattacctctgtaaagaggtggctcctccagccgtgcttgaaaacatacacagcaactgtcacggcccaatttcaatggattttgccatcagcaaactaaagaaggcaggaaaccagactggactgtatgtacttcgatgtagccctaaggacttcaacaaatacttcctgacctttgccgttgagcgagaaaatgttattgaatataaacactgtttgattacaaagaatgagaatggagagtacaacctcagtgggactaagaggaacttcagtagtcttaaggaccttttgaattgctaccagatggaaactgtgcgctcagacagtatcatcttccagttcaccaaatgctgtcctccaaagccgaaagataaatcaaaccttcttgtcttcagaacaaatggtgtttctgatgttcagctctcaccaacattacagaggcataataatgtgaatcaaatggtgtttcacaaaatcaggaatgaagatttgatatttaatgaaagccttggccaaggcacttttacaaaaatatttaaaggtgtaagaagagaagttggagattatggtcagctgcacgaaaccgaagttcttttgaaagtcctagataaagcacatagaaactattcagagtctttctttgaagcagcaagcatgatgagtcagctttctcacaagcatttggttttgaattatggagtatgtgtctgtggagaggagaacattttggttcaagagtttgtaaaatttggatccctggatacatacctgaaaaaaaacaaaaattccataaatatactatggaaacttggagtggccaaacagttggcatgggccatgcacttcctcgaagaaaaatcccttattcatgggaatgtgtgtgccaaaaatatcctgcttatcagagaagaagacaggaaaacagggaatccacctttcatcaaacttagtgatcctgggattagcatcacagttctaccaaaggacattcttcaggagagaataccatgggtaccacctgagtgcattgaaaaccctaaaaatctaactttggcaacagacaagtggagctttggcaccactctgtgggagatctgcagtggaggagacaagcctctgagtgctctggactctcaaagaaagctgcagttctatgaagataagcaccagctcccagcacccaagtggacagagttggcaaaccttataaatacttgcatggattatgagccagacttcaggcctgccttcagagctgtcatccgtgatctgaacagcctgtttactccagattatgaactgctgacagaaaatgacatgctacccaacatgagaataggtgccctaggattttctggtgcttttgaagacagggaccctacacagtttgaagagagacacttgaaatttctacagcaacttggcaagggtaactttgggagtgtggagatgtgccgctatgacccgctgcaggacaacactggagaggtggtagctgttaagaagctccagcacagcacggaagagcatctccgagactttgaaagggaaattgaaatcctgaaatccttgcagcatgacaacatcgtgaagtacaagggagtgtgctacagtgctggtcggcgcaacctaagattaattatggaatatttgccgtatggaagtttacgagactatctccaaaaacataaagaacggatagatcacaaaaaacttctgcagtatacatcccagatatgcaagggcatggagtatcttggtacaaaaaggtatatccaccgggatctggcaacaaggaatatattggtagaaaatgagaacagagttaaaataggagattttggattaaccaaagtcttgccacaggacaaagaatactacaaagtaaaggaaccaggtgaaagtcccatattctggtatgctcccgaatccttgacagagagcaagttttctgtggcctcagatgtgtggagctttggtgtggttctgtacgaacttttcacgtatatcgagaagagcaaaagcccacctgtggaatttatgcgaatgatcggcaatgataaacaagggcagatgatcgtattccatttgatagagctactgaagaacaacggaagactgccgagaccagaagggtgcccagacgagatttatgtgatcatgacagaatgctggaacaacaatgtcaaccaacgtccctctttcagggacctttcccttcgggtggatcaaatccgggacagtatggctgcatgaaagaggtgacctttactcagagaccaagtagacttccagaaccagagcaaagctctgtagccacatggccatggactcgtgtccacgggcccttatcatgatgctagccagaaggaaatgtgatgctgtctgctcaagactttggaagcgttgtggatttttatgtaccatctgta

SEQ ID NO: 2277 - DNA, 780 bp, Rattus norvegicus
  Genbank Accession No. NM_031530
gcagagacacagacagaggccagcccagaaaccagccaactctcactgaagccagatctctcttcctccaccactatgcaggtctctgtcacgcttctgggcctgttgttcacagttgctgcctgtagcatccacgtgctgtctcagccagatgcagttaatgccccactcacctgctgctactcattcactggcaagatgatcccaatgagtcggctggagaactacaagagaatcaccagcagcaggtgtcccaaagaagctgtagtatttgtcaccaagctcaagagagagatctgtgctgaccccaataaggaatgggtccagaagtacattagaaaactggaccagaaccaagtgagatcagaaactacagtcttctataaaattgcatcaaccctaaggacttcagcacctttgaatgtgaacttgacccataaatctgaagctaatgcatccactctcttttccacaaccacctcaagcacttctgtagaagtgaccagtatgacagagaactagtgtgatttggaatgtgatgccttaagtaatgttaaacttatttaacttattgatattacactattcccttccatgaatactagaaatccttaaatgcaagatgtagatccatttttttatttctctgtgaatcctggttcaacactttcaatgtatgagagatgaatgggtaaactttgtgtttgagagtccaaggtattgtttaaaatattattatggatattcctaattattaaaagaaatatattatttttgtac

SEQ ID NO: 2278 - DNA, 2061 bp, Rattus norvegicus
  Genbank Accession No. NM_031531
aacacaccagggaagtggcaaccctgaacatcaggagtcggcaatcacagaggctggcagctggctggtatcggctctgcagcctgaagactggagaagatgacccgccttgtgacttggagctcttgatggatgggatcggctctgctctcctctccttcccagattgcatactgggagaggacactctattccatgaagaccaagacaaggggacacaactggacagtctcacattggcctccatcaatactgactttgccttcagcctctacaagaagctggctttgaggaatccacataaaaatgttgtcttctccccacttagcatctcagccgccttggccgtcgtgtccctgggagcaaagggcagcagcatggaagagattctagaaggtctcaagttcaatctcacagagacccctgagacagaaatccaccggggctttggacacctcctccagaggctcagccagccaagggacgagatacagatcagtacaggcaatgccctgtttattgaaaaacgccttcaggtcctggcagagttccaggagaaggcaaaggctctgtaccaagctgaggccttcacagctgatttccagcagtctcgtgaggccaaaaagctcatcaatgactatgtgagtaaacagacccaggggaagatccagggactgatcacaaacctagctaagaagacatccatggtactggtgaattacatctactttaaaggcaaatggaaggtgccttttgaccctcgggacacattccagtctgagttctactctggcaaaaggaggtctgtgaaagtgcccatgatgaagcttgaggacctgaccacaccctacgtccgggatgaggagctgaactgcactgttgtggagctgaagtacacaggaaatgccagcgccctgtttatcctccctgaccagggcaagatgcagcaggtggaagccagcttgcaaccagagaccctgaggagatggaaggactctctcaggcccagcatgatagatgagctctacctgcccaagttctccatctctgctgactacaacctggaggacgtccttccagagctgggcatcaaagaagtcttctccacacaggctgacctgtctgggatcacaggggataaggacctgatggtctttcaggtggtccacaaggctgttctggatgtggctgagacaggcacagaagcagccgctgccacaggggtcaaatttgttccaatgtctgcaaaactggaccctctgattatagctttcgaccggcctttcctgatgattatctctgacacagaaactgcaatagctccctttttggccaagatatttaaccccaaatgagattcgaacttcccaagagttgatgcttctcctgaggcattgagcctgtctgtgggtctctgtgtgcattttcgcttctatgctgtgattggccatggcggcatgcctggatgagacagtaactaactgtgtaacagtcctcatgtacagacgcctgtgcagagtcgctgccatgctcccaaacttcttggtaccactagctcatatttctgagcctaaaatttgtctttcccctgcccttgctctctctcccctgtatctgcctcaacccagaagccagggccccatcaggttgtctcagtcccaacttaggctctagttatatcttccttcagcgttgctgtcttgatgggactgtgcacgattaccggccaacccacatggaccaagaagaacacttgctggtccctatctttctgcagtatgtgggaatcacttggtgcccagtgctgcctcactatttccttcctctgggcacagtgctccttgcagcactggcctgactttgtccacatctggcacagagctggagccctcccttctgcagatgcatggcacctgtgggtcagaccagatccccctccccagcactcctacttagagcaatgcagcctttcttttagttcccagctgaccaacctcacacaaaagatgaccaacaacaaccaaaatgaagaggtaggagcaaaggatcaataaacacatc

SEQ ID NO: 2279 - DNA, 1607 bp, Rattus norvegicus
  Genbank Accession No. NM_031537
tatttctgactggcctgctgtgcagaatctagaccactggcagtgggtgacagcccagttgaggttaatcgaagtctcgtcgcaggctctgcttggtcttgggagttgctatgtcctggttcttggtcctgaagtgcctccttactgtctgcatcatctctcacttatctgtcagctctacagagagttatggttgtataagaaaaacatgctttggtggaagatgtttacataatactactagatcttgtgaattctccaaaggttgtttctcccaactgcaggaatttgcagtcccactacttctattaaaccgaagagttgagcagagaggctgttctgaagacaattgtactgaactagcattctcggcaacactggggattgattggatgtttagttataaccatcaatgctgctacagtgaacagtgcaacaacaagcccattaatgtgtctccattgtctttacaacccaatggtgttgaatgtccaacctgctacagtgaacttggcacgtgtaggccagtctccctaaagtgcacaggggcacagacgacgtgtgttaatgtcactggscaaggaattagggaggacttcattaagatacacgccatgggctgtgcaacccagactgcctgcaacttgaagaacgtgatcatcttgaataatattaaaatcgatacctcctgtgtcagtgggagccccccactcaggtactccccctctctcagcacggatcaaaagacgagctcagcaactgctcccacactgtgcctgcttgctgctgtgctccctgccatcatggtcatggagtcattctctgaactgtgaacgctcagtaaactctttcttttggaaatttccttggtcatggcgtcttcacagcaatagaaaagaaactaagacatcatttctggaaaagtagtagcatcaaaaccccctttcaataagaatagcaagaaccagaaccggctaaagtgatctcattttaatttgatcatttctataaagatcttgccttgggctggagagatggctcagtggttaagagcactgactgcttttccagaggtcctgagttcaattcccagcaaccacagggtggctcacagttatctgtagtgggatcagatgtcctcttctggtatgtctgaagacaacaacagtgtacccacatatataatcttgtcttgccaacttgacacaaaccagggtcacctgggaagagggaacctcaacagagaaaaatgcctccatcagattggtttgtagaaaaattcgtggagcatttccttgattgatgtttgatgtgggaccaagcccactatgggcagtaccatccctaggcaagtggtcctgggaggaatgagaaaggaggacatgcctagcaagcacaaggccctgggttcggtctccagctccaaaaaaaaaaaaaaaaaaaagaaagaaaggaggacaaacataagcctgaggagccagtcagtaagcagtgmacctccatgatactacatttcctgtctccaagttcctaccttgagatcctgccctggctttcctccacggtgtaacctgtaagataaaataaagactttccttcctcgtgcc

SEQ ID NO: 2280 - DNA, 2497 bp, Rattus norvegicus
  Genbank Accession No. NM_031541
ggaatcccgcgccgaacacgggggcgggctgcccgggccatggcgcataaaacctctggccacctgcagggctactgctgctctggccactgtcaggcacacaccttgctgctcggtttctgtcatctctgtggcctccgtcgcctctgtcgccgtccccttcaggtcctgagcccagcgactctcggccgcgcacgcggacatgggcgtcagctccagggcacgctgggtggccttggggctgggcgttctagggctgctgtgtgctgcgctcggcgttatcatgattctcatggtgccctcgctcatcaagcagcaggtgctcaagaatgtccgcatagaccccagcagcctgtcctttgggatgtggaaggagatccctgttcccttctacttgtccgtctacttcttcgaggtggtcaaccccagcgaggtcctaaatggccagaagccagtagtccgggagcgcggaccctatgtctacagggagttcagacaaaaggttaacatcaccttcaatgacaatgacacggtgtcctacatagagaaccgaagccttcgtttccagccagacaggtcccagggctcagagagtgactacattgtactgcctaacatcctggtcctgggaggggcagtgatgatggaggacaagcccacaagcctgaagctgctaatgaccttggggttggtcaccatgggccagcgggcctttatgaaccgcacggttggtgagatcctgtggggctacgaagatccctttgtgaatttcctcagcaaatatttcccagacatgttccccatcaaaggcaaatttggcctgttcgttgggatgaacgactcgagttctggcgtcttcaccgtcttcacaggtgtccagaatttcagcaagatccatctggtggataagtggaacggcctcagcgaggtcaactattggcattcggaacagtgcaacatgatcaatggtactgccgggcagatgtgggcaccattcatgacacccgaatcctcactggaattcttcagcccagaagcctgcagatctatgaagctcacctaccaggaatcaagggtgttcgaaggcatccccacttatcgcttcacggcccccgatactttgtttgccaacgggtccgtctacccacctaatgaaggcttctgcccgtgccgcgagtccggcattcagaatgtcagcacctgcaggtttggtgcgcccctgtttctctcccagccccacttctacaatgctgaccccgtgctgtcagaagctgttcttggtctgaaccctgacccaaaggagcattccttgttcctagacatccacccggtcactgggatccccatgaactgttccgtgaagatgcagctgagtctgtacatcaaatccgtcaagggcgtcgggcaaacagggaagatcgagccagtagtcctgccattgctgtggttcgaacagagcgggatgatgggtggcaagaccctgaacacgttctacacgcagctggtgctgatgccccaggttcttcactacgcgcagtatgtgctgctggggcttggaggcctcctgcttctggtgcccatcatttaccaactgcgcagccaggagaaatgctttttattttggagtggtagtaaaaagggctcgcaggataaggaggccatgcaggcctactctgagtctctgatgtcaccagctgccaagggcacggtactgcaagaagccaagctgtagggcccagaagacaccacgagccccccaaacctgatagcttggtcagaccagccgcccagtccctacaccccacttctcgaggactctctcagcggacaacccgccagtgccacgtcctgagcccccagatgtcacactgtccacacggcacatagtgtgcggaaacactcagggaccagggacagacccgctgctgagtagagcctgttgggccacaggcgacctcttctaagtgacctgtgagccaggctgtgggaactgtagctgcccctcctgtaggagctggcgccgccggggctcctgactttctccgtctttctccagcaggctgaaagccttagttcccacagaggacacagatctgtcactcctaggggctgggcaaacatcggcctcttgcgtcacggctggacaagcagttccagatcctgaccagtctgcacacacactctggcgctgtatctggcccttctcctacagtctctgctgtcacctgaacactgaattggccactgtaagtggcagcggtggcaggccccctcagggtccttatttttcaggcgtggggtcaaagagagaggtgtgggccgtctacccctggcacctagtatatctcaccagagggtagggtatacagaggcccagcgtcccacaatcgaccccttttttttctactggaagagaaattttatcgtcttttgaaagaaagtcatgactgaagcaataaaccttttcacaaattcaaaaaaaaaaaaaaaaaaaaaa

SEQ ID NO: 2281 - DNA, 1624 bp, Rattus norvegicus
  Genbank Accession No. NM_031543
gccctagcgcacatggcggttcttggcatcaccattgccttgctggtgtgggtggccaccctcctcgtcatatccatctggaagaagatctataacagttggaacctgcccccaggacctttccctcttcccatccttgggaacatttttcagctggatttgaaggatatccccaagtctttcaccaagttggcaaagcgcttcgggccagtgttcacactgcaccttggctcaaggcgcatcgtggtcctgcatggctacaaggctgtcaaggaggtgctactgaaccacaagaatgagttttctggacggggggacattcctgtgttccaggagtacaagaacaaggggattattttcaataatgggcccacatggaaggatgtgcggaggttttccctaagcattctccgagactggggaatggggaaacagggtaatgaggcccgcatccaaagggaggcgcaattcctggtggaggagctcaaaaagaccaaaggccagccttttgaccccacatttctgattggctgcgcaccctgcaatgtcattgcggatatcctcttcaacaaacgtttcgactacaatgacaagaagtgtctgaggctcatgagtttgttcaatgaaaacttctacctgctgagcaccccctggatccagctttacaataactttgcggattatctacgatacctacctggaagccatagaaaaatcatgaaaaatgtgtctgaaataaaacagtacacacttgaaaaagccaaggaacaccttcagtcactggacatcaactgcgcccgggatgtgactgactgtctcctcatagagatggagaaggaaaaacacagccaagaacccatgtacacaatggaaaatgtttctgtgactttggccgacctgttctttgcaggaactgagaccaccagcacaactctgagatatgggctcctgatcctcatgaaatacccagaaattgaagagaaacttcatgaagaaattgacagggttattgggccaagccgcgtccctgctgtcagagacagactggatatgccctacatggatgctgtggtgcatgagatccagagattcatcaatcttgtcccttccaacctaccccatgaagcaaccagagatactgtgttccaaggatatgtcatccccaagggtacagttgtgattccaactctggactccctcttatatgacagccatgagtttccagatccagagaagtttaaacctgagcatttcctgaatgaaaatgggaagttcaagtacagtgactatttcaaggcattttctgcaggaaagcgtgtgtgtgttggagaaggcctggcccgcatggaattgtttctgctcctgtctgctattctgcagcattttaacctgaagtctctggttgaccctaaggatatcgacctcagtcctgtcacagttggctttggcagtatcccaccccaatttaaactctgtgtcattccccgttcatgagacctgaaaacttcctgatatcccttccattgttatcccttaaactatgactgtttttaaaaaacccaagcatatagagttcctatcataaaatgaaaccgaaaaaataaataaaaccttgatgaattgt

SEQ ID NO: 2282 - DNA, 628 bp, Rattus norvegicus
  Genbank Accession No. NM_031545
gcgagacaagagagagcaggacaccatcgcagctgcctggcccatcacttctgcagcatggatctccagaaggtgctgccccagatgattctgctcctgcttttccttaatctgtcgccgctgggaggtcactcccatcccctgggaagtcctagccagtctccagaacaatccacgatgcagaagctgctggagctgataagagaaaagtcagaggaaatggctcagagacagctctcaaaggaccaaggccctacaaaagaacttctaaaaagagtccttaggtctcaagacagcgccttccggatccaggagagacttcgaaattccaagatggcacatagttcaagctgctttgggcagaagatagaccggatcggcgcagtcagtcgcttgggctgtgacgggctgaggttgttttaggaagacctcctggctgcagactccggcttctgactctgcctgcggctcttctttccccagctctgggaccacctctcaagtgatcctgtttatttatttgtttatttatttatttttatgttgctgattttctacaagactgtttcttatcttccagcacaaacttgccacagtgtaataaacatagcctatttcttgcttttgg

SEQ ID NO: 2283 - DNA, 734 bp, Rattus norvegicus
  Genbank Accession No. NM_031553
aggttaaaattggacaaagatccaccacctttaggacaggtgttcaagaaccctgcagataacacaattctgacagtatttcatgacaatggatggcgacagctctacaacagatgcttctcaactagggatttctgcagactacatcggaggaagtcattatgtgatccagccccacgatgatactgaggacagcatgaatgatcatgaagatacaaatggttcaaaagaaagtttcagagaacaagatatttatcttcccattgcaaatgtggctaggataatgaaaaatgccatacctcaaacaggaaagattgcaaaggatgccaaagaatgcgttcaggagtgtgtgagtgagtttataagcttcataacatctgaagcaagtgagcgctgtcaccaggagaagcggaagaccatcaacggggaggacattctgttcgccatgtccactctcggcttcgacagctacgtggagcctctgaaactgtacctccagaagttcagagaggccatgaagggagagaagggcattggtggggccgtgtctgctacagatggactcagcgaggagctcacggaagaggcattcactaaccagttaccggctgggttaataactgcagatggccaacaacaaaacgttatggtttacacgacgtcctatcaacagatttctggtgtccagcagattcagttttcatgatatgaaggaaggatggagccgggctgtg

SEQ ID NO: 2284 - DNA, 537 bp, Rattus norvegicus
  Genbank Accession No. NM_031556
atgtctgggggtaaatacgtagactccgagggacatctctacactgttcccatccgggaacagggcaacatctacaagcccaacaacaaggccatggcagacgaggtgaatgagaagcaagtgtacgacgcgcacaccaaggaaattgatctggtcaaccgcgaccccaagcatctcaacgacgacgtggtcaagattgactttgaagatgtgattgcggaaccagaagggacacacagtttcgacggcatctggaaggccagcttcaccaccttcactgtgacaaaatattggttttaccgcttgctgtctaccatcttcggcatccctatggcgctcatctggggcatctactttgccatcctctctttcctgcacatctgggcagttgtaccgtgcatcaagagcttcctgattgagattcagtgcatcagccgtgtctattccatctacgtccacaccttctgtgatccactctttgaagcgattggcaagatattcagcaatatccgcatcagcacgcaggaagagatatag

SEQ ID NO: 2285 - DNA, 1618 bp, Rattus norvegicus
  Genbank Accession No. NM_031557
ggagccatgtcctgggccgctctgctcggccttctggccgtgttattactgttgctgctgctgctgagccgccggcgcgcgcggcgacccggtgagcctccgttggacctgggcagcatcccctggctgggccatgccttggagtttgggaaggatgccgccagcttccttaccaggatgaaggagaagcacggtgacatatttactgtgctggtggggggcaggtatgtcactgtcctcctggacccacactcttacgacacagtggtgtgggatctgcgtacacggctggacttccacccctacgccatcttcctcatggagaggatttttgatctgcagcttccaaatttcaaccccagcgaggagaaggccaggatgaagccgacgctcatgcacaaagacctgcaggcgctcacggaagccatgtataccaacctgcgcaccgtcctgctgggtgactccacagaaggaggcagtggctggcaggagaaaggtctgcttgagttctcctacagctccctgctcagcgctggctacctgaccctgtatggagtggaggcctcaccacgcacccacgagagtcaggccctcgaccgtgaccactcagccgacgttttccgcaccttccgccagctggatctgatgctccccaaactggctcgaggctccttgtcagtgggggataaagaccatgcatgcagtgtcaaaagccgcctgtggaagctgctgtctccagccggactggcctccagggctgaccggagcagctggttggagagttacctgagacatcttgaggagatgggggtatcagaggacatgcaggcccgggcactggtgctgcagctctgggccacacaagggaatatgggacccacggctttctggctcctcctcttcctcctcaagaacccggaagccctcgatgctgtccatgcagagctgaaacgcatcgtctggcaagcagagaagcctgttttacagatgaccgcactcccgcagaagattctagacagcatgcctgtgctagacagtgtgctcaatgagaccctccggctcacggccgcccccttcatcacccgtgaggtcatggcagacctggccttgcctatggcagacaggagggaattctctcttcgacgcggtgaccgccttctcctctttcctttcctgagcccccagaaggacccagaaatctacacagaacctgaagtctttaaatacaaccggttcttgaacccagatgggtcagaaaagaaagatttttacaaagatgggaaacggctaaagaattacaacatgccttggggcgcagggcacaaccagtgcctggggaagagctatgccatcaacagcatcaaacagtttgtggtcctgctgctgactcatttcgacctggagctggtcagtgaggacacagaggtcccggagtttgaccttagcagatatggctttggcctgatgcagccggaggaagatgtgcccatccggtaccgtaccaggctgtgacctgtggagcagacactacactcatctggggcctcctgacttcctgttgttcctccagaatgctgtgtccagaggaggggacagtgagaacaccgagagcaggaaa

SEQ ID NO: 2286 - DNA, 2436 bp, Rattus norvegicus
  Genbank Accession No. NM_031561
cggcattgtaattgtacctgtgagttggcaagaagcaagtgctcttccttgattctgctgcacgaggaggagaatgggctgcgatcggaactgtgggctcattactggagccgttattggtgctgtcctggctgtgtttggaggcattctcatgccggttggagacctactcattgagaagacaatcaaaagggaagttgtccttgaagaaggaaccattgctttcaaaaactgggtgaaaacgggcaccactgtgtacagacagttttgggtctttgacgtgcaaaacccagaggaagtggcaaagaatagcagcaagatcaaggttatacagagaggtccttacacatacagagttcgctatttagccaaggaaaatataactcaggaccccaaggacagcactgtctcttttgtacaacccaatggagccatctttgagccttcactgtctgttggcacagagaatgacaacttcacagttctcaatctggctgtggcagctgcaccacatatctacacaaactcatttgttcaaggtgtgctcaacagccttatcaaaaagtccaagtcttctatgttccaaacacgaagtttgaaggaactcttgtggggttacaaagatccattcttgagtttggttccatatcctataagtaccacagttggtgtgttttatccttacaataacactgtagatggagtttataaagtttccaatggaaaggataacataagcaaggttgccataattgatacctataaagggaaaaggaatttgtcctattgggaaagttattgcgacatgattaatggcacagatgcagcctcctttccacctcttggtgagaagtctcgaacactgaggttcttttcctctgacatttgcaggtccatctatgctgtgtttgaatctgaagtgaaccttaaaggaatccccgtatacagatttgttcttccagccaacgcctttgcctccccactccagaacccagacaaccactgtttctgcactgaaaaagtaatctcaaataactgtacgtcgtatggtgtgctggacattggcaagtgcaaagaagggaaacctgtgtacaattctcttccacatttcctacatgcaagtcctgatgtctcagaacctatcgaaggcttgaatcctaccgaagatgagcataggacatacttggatgtggaacccataactggattcactctacagttttccaaacgactgcaggtcaacatactggtcaagccagctagaaaaatagaagcactgaagaatctgaagagaccttacattgtacctatactgtggctaaatgagactgggaccatcggcgatgagaaagcagaaatgttcagaaaccaagtgaccgggaaaataaagctcctgggcctggttgagatggtcttacttggtgttggagtagtgatgtttgttgcttttatgatttcatactgtgcttgcagatctaagaatggaaaataagtagtggatgagcctacattatgcactagctacatttttggtaaaaccaatctccaaaacgaagacttaagacatgcttgtttttataaaacacacctatctgtagttgaagaaacggtggtgtgcgcgctctctctcttattgcagatatatattcattcatatattgcaataagccacagcatattttgacaagatcaatatgtcactaagcctatatttttaataaaatcttgtattttgttaagtccatcatctgcaactgagtggacttcaatttctgcagaactaattatcttttttggttctgatttactgatttttttttcctgttgccaaatttcaagaatgtatatattctaagaaacgctttgttcctcatcgaagtaaactgttatcatgtctggggtgaccctttcatttatagcaaatgttccttgtgactgtcagcacatgatatgtcatttattacatcattttaaagatttaaggatgaaaaatgaacaattcacatatgaaccattgctaatatattgtttaagcctctccctctctggtgtccttggcaacaacaaggccaggtatcacagatattttttctttttactttcttaacacagagcttaatatgttctgttcctcgccatgaaatgaactatttttagcacattttagctcttgaattttaagtatgttgtcaagttccaggctgcctagctcttttgaaaactgagtaggtttttctctttctgctcagccacaactaatgtaacttcagagagctgttatagtggtaaaagatgtaatttataataaatggattatgatatagaatcttacaaaagctagaattggctttaaatatgtatttgtggtaatatattctgcttttataatcacccagaaataactggtttctaacattaaagatgttcttaaattcc

SEQ ID NO: 2287 - DNA, 650 bp, Rattus norvegicus
  Genbank Accession No. NM_031570
cactccgtaagacgaagccatgtctagctcgagcgccaagattgtgaagcccaatggcaagaagcgagacgagttcgagtctggcatctctcaggcgctgctcgagctggagatgaactccgaactgaagacgcagctgtgggaactcaacatcaccgcggcaaaggaaatcgaagtcggtggtggtcgaaaagccatcataatttttgtaccagttcctcagctgaaatctttccagaaaatggccaagtccggcaaggttcgcgaattggagaaaaagttcagtgggaaacacgtagtcttcattgctcagaggaggattctgcccaagccaacccgaaaaagccgtacgaaaaataagcaaaaggcccagaagccgaccctgacgagcagtgcagaccgacgcatccttgaggatttggtcttcccaagtgaaattgtgggcaagaggatccgtgtgaaactggtaggcagccggctcataaaagttcatttagacaaagcacagcagaacaacgtggagcacaaggtcgaaactttttctggcgtgtacaagaagccactaggcaaggatgttaactttgaattcccagaagtttcagtttaaagaaaaatgactgaataaaatgtcattcataataaaaaaaaaa

SEQ ID NO: 2288 - DNA, 1388 bp, Rattus norvegicus
  Genbank Accession No. NM_031573
gaattcctgtcacttccattcaagagcctacaagaacctaactaggtgcttgggatcccctgagatccagctgaccatgacccgggatgaggccctccctgactctcattctgcacagaatttctatgagaactacgagcccaaggagatcctgggcaggggagtcagcagcgtggtcaggagatgcattcacaaacctacgtgccaagaatacgcagtaaaaatcatcgacatcaccggcggaggaagctttagctccgaggaggtacaggagcttcgggaagccaccctgaaggaggtggacattctgcagaaggtctcaggacaccccaacatcatacagctgaaggacacttacgagaccaacactttcttcttcttggtatttgatctgatgaagagaggggaactctttgactatctcacagagaaggtcaccttgactgagaaggaaaccagaaagatcatgcgggccctgctggaggtggtctgcaccttgcacaaactcaacattgtccatcgggacctgaagccggagaacatccttctggatgacaacatgaacatcaagctcactgacttcgggttttcctgccagctgcagccaggagagaagctccgagaggtttgtgggactcccagttatctggcccccgaaatcatccagtgctccatggacgaaggccatcctggctatggaaaggaggtggacatgtggagcacaggagtcatcatgtatacgctgctggctggctccccgcccttctggcaccggaagcaaatgctaatgttgaggatgatcatggatggcaaataccagttcggctcaccagagtgggatgactactcagataccgtgaaagacttggtatctcgcttcttggtggtgcaaccccaggaccgctgctcggcggaagaggccttggcgcatcctttcttccaggagtacgtggtggaagaggtgcggcacttcagccctcgagggaagttcaaggtcatctgtctaactgtgctggcctcggtaaggatctactaccagtaccgtcgggtgaagccggtaaccagggagatcgtcatccgagacccctacgccctacggccattgcgcagactcatcgacgcctatgctttccgcatctacggccactgggtgaagaaagggcaacagcagaacagagctgccctcttcgagaacacgcccaaggcagtgctcctctccttggctgaggaggaggacttctgaggggtggcggggcacaggggagaaagcaaacagggtacgcgcccccagaactgtgagaagaggatgcctcaaggaggaggcttctgcaaaggagctgtgaccctactctgcactctcaaaggctcgccactagatgcgggaattc

SEQ ID NO: 2289 - DNA, 2441 bp, Rattus norvegicus
  Genbank Accession No. NM_031576
gatctggtcggtaccggagagcgcaggttgtatcaccaacatgggggactctcacgaagacaccagtgccaccatgcctgaggccgtggctgaagaagtgtctctattcagcacgacggacatggttctgttttctctcatcgtgggggtcctgacctactggttcatctttagaaagaagaaagaagagataccggagttcagcaagatccaaacaacggccccacccgtcaaagagagcagcttcgtggaaaagatgaagaaaacgggaaggaacattatcgtattctatggctcccagacgggaaccgctgaggagtttgccaaccggctgtccaaggatgcccaccgctacgggatgcggggcatgtccgcagaccctgaagagtatgacttggccgacctgagcagcctgcctgagatcgacaagtccctggtagtcttctgcatggccacatacggagagggcgaccccacggacaatgcgcaggacttctatgactggctgcaggagactgacgtggacctcactggggtcaagtttgctgtatttggtcttgggaacaagacctatgagcacttcaatgccatgggcaagtatgtggaccagcggctggagcagcttggcgcccagcgcatctttgagttgggccttggtgatgatgacgggaacttggaagaggatttcatcacgtggagggagcagttctggccagctgtgtgcgagttctttggggtagaagccactggggaggagtcgagcattcgccagtatgagctcgtggtccacgaagacatggacgtagccaaggtgtacacgggtgagatgggccgtctgaagagctacgagaaccagaaaccccccttcgatgctaagaatccattcctggctgctgtcaccgccaaccggaagctgaaccaaggcactgagcggcatctaatgcacctggagttggacatctcagactccaagatcaggtatgaatctggagatcacgtggctgtgtacccagccaatgactcagccctggtcaaccagattggggagatcctgggagctgacctggatgtcatcatgtctctaaacaatctcgatgaggagtcaaacaagaagcatccgttcccctgccccaccacctaccgcacggccctcacctactacctggacatcactaacccgccacgcaccaatgtgctctacgaactggcacagtacgcctcagagccctcggagcaggagcacctgcacaagatggcgtcatcctcaggcgagggcaaggagctgtacctgagctgggtggtggaagcccggaggcacatcctagccatcctccaagactacccatcactgcggccacccatcgaccacctgtgtgagctgctgccacgcctgcaggcccgatactactccattgcctcatcctccaaggtccaccccaactccgtgcacatctgtgccgtggccgtggagtacgaagcgaagtctggccgagtgaacaagggggtggccactagctggcttcgggccaaggaaccagcaggcgagaatggcggccgcgccctggtacccatgttcgtgcgcaaatctcagttccgcttgcctttcaagtccaccacacctgtcatcatggtgggccccggcactgggattgcccctttcatgggcttcatccaggaacgagcttggcttcgagagcaaggcaaggaggtgggagagacgctgctatactatggctgccggcgctcggatgaggactatctgtaccgtgaagagctagcccgcttccacaaggacggtgccctcacgcagcttaatgtggccttttcccgggagcaggcccacaaggtctatgtccagcaccttctgaagagagacagggaacacctgtggaagctgatccacgagggcggtgcccacatctatgtgtgcggggatgctcgaaatatggccaaagatgtgcaaaacacattctatgacattgtggctgagttcgggcccatggagcacacccaggctgtggactatgttaagaagctgatgaccaagggccgctactcactagatgtgtggagctaggagctaccagcctcccacccctcgctccctgtaatcacctaacttctgccgacctcacctctggtggttcctgcctggcctggacacagggaggcccagggactgactcctcctggcctgagtggtgccctcctgggcccctaggcagagcccggtccattgtatcaggcagcccagccccagggcacatggcaagagggactggacccacctttgggtgatgggtgccttaggtcctctgcagctgtacagaaggggctcttctctccacagagctggggtgcagcccccacacgtgattttgaatgagtgtaaataattttaaataacctggcccttggaataaagttgttttcagtaaatt

SEQ ID NO: 2290 - DNA, 616 bp, Rattus norvegicus
  Genbank Accession No. NM_031577
gtacgtgctctggaacatgcaggcccaggacggagaaggaggcgtcctgctcctgccagccttaagatgggaattttagggtctggacatcactggtgctccaggtcagctttcctggttgcagatctctcctggtcaaggctcccagctcgcctggatcccacaactgcacagtgtcccgcccaggagtgaaggatgccactctgggtgttctttgtgctcctcaccctcaccagtggctcccactgctcactgcccccctcacctcccttcagggtgcggcggcatgcagacgccatcttcaccagcagctaccggagaatcctgggccaattatatgcccgcaaactgctgcacgaaatcatgaacaggcagcaaggggagaggaaccaggaacaaagatccaggttcaaccgccatttggacagagtgtgggcagaggacaagcagatggccctggagagcatcttgcagggattcccaaggatgaagctttcagcggaggcttgagccctcggcccccaaacatagctggaccctgttacttctacttcagttctgatcttctccttcctctgtgaatacaataaagacccatctcatctgcaaaaaaaaa

SEQ ID NO: 2291 - DNA, 3581 bp, Rattus norvegicus
  Genbank Accession No. NM_031578
gggctgtagaggcctctgcacctcctcctctggcctgaggggggcatacccgcgtctacagacgcggggcgcaacctgccgaaaggggtcacaccgctgggcgagagctaggggaggagtcaccttgagaggaggggtcacaatgattagccgagtcactctgaaaggtctcttttagtgaaaggaacacaaagaggagggggtgcagcactaaggggctctggatacacactgatgtgccagtgtcatcccaaggaaaggtccccctgaaggagagcgggctccgaggggcagcggcctttgagggggcgggatcctgtcgaggggtgggctgtgacggagggcggggctttcttgcaggtgcaggcttcccctaagagggttattaggacaaagaagtaggagggtggtcaccgggcggagcgcaggaatctcaactttactcaggggaatggagatggagtgaggaggggtcgggccaggtcagggatgcggaggccagaggctccctacagccctgggtaccacgaccggagaaaacaggtgttagcgagccccgagatttagggtgtcggggtcagaagccccttgaaatgggcagtcggagtggggcgcagactgggcaggcagcgggcttgatccgtggagcccagggcgcaggagaattcgcgcctgcagtcaacccttaagtcgtcctgttattcacgccccggcctacgcgccgggacgcacctgagggggcgtggccgggccacagctcgggctccaaggagttaaccgcagacccggccggccacgccccgggcaggccgcgcagcctgagcccggcggcgaagcggagcagcagccgcccgcggggagcccgccgccggcgcccgggagcgccgccgccgcccggcccaggcccaggcccaggccccgcgcagagcggagagccgcggcgttccaccaggcccaactcgccggcgcggcgggggcgggcccaggaccttcggcaggtcctcccggagtccgccgggcgggagtcccggcacccgggatcaggttgggccggcgcccatggcgagcgcggcctgcccgggtcccggggatccggccatgtgaagcaggccggggctgggggcccggccatggccggggaacggccaccgctgcggggccccgggcccggagagactccggtggaggggccggggggcgcaggcggaggcccgggccggggccggccctcctcctaccgggccctccgcagcgccgtgtccagcctggcgcgcgtggacgatttcgactgcgcagagaagatcggggctggtttcttctctgaggtctataaggttcggcaccgacagtcgggacaagtcatggtgctgaagatgaacaagctccccagtaaccggagcaacactctaagggaggtgcagctgatgaaccggctccggcatcctaacatcctcaggttcatgggggtctgtgtgcaccaagggcagctgcacgcgcttacagagtatatgaatgggggtaccctggaacagctgctgagctccccagaacccctctcctggccagtcaggctccacctagcactggacattgcacaaggcctacggtacctacacgccaaaggtgtgtttcaccgagacctcacatccaagaactgtctggtccgacgggaagacggaggcttcacagctgttgtgggtgacttcggactggctgaaaagatccctgtgtatagggaaggggcaaggaaggagccattggctgtggtgggctccccatactggatggccccagaggtgttgcggggagagctgtatgatgagaaggccgacgtcttcgcctttgggattgtcctctgtgagctcatcgcccgagtacctgcagaccctgactacctaccccgtactgaggactttggtctggatgtgcctgcttttcgaactctggtgggaaatgactgtccgctacctttcctgcttctggccatccactgctgcagcatggaacccagcgcccgtgccccttttactgaaattacccagcacctggaacaaatcctggagcagctgcctgagcccacgcccctcgccaagatgccccttgccaaggctcccttgacatacaatcaggggtctgttccaagaggaggtccctctgccacgcttcccaggtcagacccccggctctcccgaagccggtcagacctcttcctgccaccttcaccagaatcaccccccagttggggggacaatctaacacgagtcaaccccttctcactgcgggaagacctcaggggtggcaagatcaaacttctggacacaccctgcaagccggccactccactgcccctggtgccaccatcaccactgacctctacccagctgcccttggtggcctctccagagtccctggtccagcctgagactcccgtccgccgctgtcgttcactcccttcatcccctgagctcccccgacggatggaaactgcactgccaggtcctggcccgtcccccgtgggcccctcgactgaggaaaggatggactgtgagggcagcagccctgagccagagcccccagggccggctccccagctgcctctggctgtggccactgacaacttcatcagtacgtgttcctcagcctctcagccctggtctgctagaccaggaccttccctcaataataacccccctgctgtggtggtgaattccccacaaggatgggcgagggagccctggaaccgggcacagcatagccttccccgggcagcagccctggagcggacagaaccctcaccacccccatcagctccccgggagcaggaggaggggctgccctgccctggctgctgcctcagccccttcagctttggcttcctatccatgtgcccccgccctaccccagctgttgcccgctaccgcaacttgaactgtgaggcgggcagtcttctctgccaccgagggcatcatgccaagccacccacacccagcctgcagctgcctggggcacgctcttagcactgaggcctgtgatctcaggcttccaaccttggccttcgggataccctgtaaggacagagtgcacttgctggacaatgccagccccagatgggctgactggctcttctccccgtataggggagcctcagcatggtctcaatggacagagcacttcctgtccaacccctgggatcactggactagacacagcattgctgacacacaagactaacacgtgcaaaatatttaaaaatatttcaataaaactgcctggctggctccgggccatccatccactcagcggagcgccctcccctgacccatctctagttcgggaagttcttaaggaaggtcaaagtcttttctggaggcttctttactcttcccaagaatagtttctggagcagctttcaagcaagcagcaggtcgccagaccagaatcagcccttagctgggcgtgcccaagagtgagggagtgctggaggaatagcagtcttgagaattggcaggccataggttaaggatgtaggtcacaaggtcttgttcaagtgtctggaaaaataaagcaccagtgagctcccc

SEQ ID NO: 2292 - DNA, 2638 bp, Rattus norvegicus
  Genbank Accession No. NM_031579
cacaatcttcaatgagtagacatattcctcagttctgtggtgttctcggtcacacatttatggagtttctgaagggcagtggagactactgccaggcacagcacgacctctatgcagacaagtgaactgtagaaattcattactactccaccaagaagcccccataagagtggatagcctggacacagtcgtgttgaattgaaatctgcagagcattttccaagagctcagacctggatggggtaaacctcagtgcacttcctctgtatcgcctcagtattcctggattgaagagtcactgcttcttgtgaggaggttcatttcattgcccgtttctcccgactcatactcaaagcactgagaatttcaagtggagtatattgaatattgaagtagacttcaggttgttttttggttttgttttggttttttgttttgttttgttttgttttgttttggttttcagtttttgtttggaatcatttctgtattcaattttttaattctttcataaccctattgggtgtttttttaaactaaattaacatggctcgaatgaaccgccctgctcctgtggaagtcacatacaagaacatgagatttcttattacacacaatccaaccaatgcgaccttaaacaaatttatagaggaacttaagaagtatggagttaccacaatagtaagagtatgcgaagcaacttacgacactactcttgtggagaaagaaggcattcatgttcttgactggccttttgatgatggtgcaccaccatccaaccagattgttgatgactggttaagtcttgtgaagattaagtttcgtgaagaacctggttgctgtattgctgtccattgtgtcgcaggccttggcagagctccggtgcttgttgccctagcattaattgaaggtggaatgaaatatgaagatgcagtacaattcataagacaaaagcggcgcggagcttttaacagcaagcaacttctgtacctggagaagtaccgtcctaaaatgcggctccgcttcaaggattccaacggtcatagaaacaactgttgtattcaataaaactggggtgcctgatgccattgccttggaagaggaacttcagatgggacctgatttgttatttacccaatgtgtccacttacctgtggaagctccaggggaatattgaaaaagttttaccaggccacaagcttgacagaattgcaacctctataattgggctatgatcaacacgtttggacacttagcaaaagatttttgctggtcagcatttaaaatgtgcttattatttgtaccaattgacctttcctaaaataaggtattgagtaatgtcattaaatgtactcctgtgccagaatattattagtctataaggaatttagaaggattaggtgccaaaatacccagcacaatacttgtatatttttagcatcatacagaaccaaaattccaagaactaagaactctccagaccttccatggtgtattccttcagtcatttcaaacaccgcagggcttctcttgttatctgcctgctcactctatgtttacatctcccacacttacaccagaacacatcaggtttgcttagctatcttttaagtcttgcaatgattatttaatgtctctgtcttattttgtgctgttttgggaaacctccatttgaaaatcaactttgttacagaagcacatatcttcaataatgtctccagacaaaaagccttatagttaatttaatgtttgcactcgggtgcaacctgacagggagggcctgaacaagaaaggagaggaggctattaaatatttttagtaatatgttgcctttgtcttgtgcagaacatgtagagtatgctctttaatttagtaaatatttttaagacgtagagatacattgttgtagctaaccacttaatcaaaatttctgaaattcttgtgttttccatacctatctgaggttttccaacttgtttgaattatggttttccccttctcttcccaatctcttgcaaaaaagtaaaagtgggatctgctagtgaactgagcagaaatattttatacgccttttgagctatgtaacttaataattggatacttgatcatttgttttattatgtaatcgataaaatggtgatgtgtattaatgttagttcaaccatatatttatactgtctgggaatgtgtggttatagttctgtgggagaaatagtttgtcagtgttcaccagcttgtaaaaacttagtgcgagagcttcaacatctaaataaatgatgaaacgcattcgtcactgaggtcactttgcttaaaattaacttaatttgtagaaaacagtggattcaattattatcatttcagtttatggacaaatttgttagggttaccaagtgcgtttaaaaattgctctttaaaggtctagataattgtgaatcaattgaatgttgggtaccaagggaaaacggtttgtaatagttgatgaccttgatttttaattcaattccaccagtcacttgtagctttatgcagtttccaatccacttttctcatttttaagtttattacttacctgtatatattttgaaattaatttgaacctgcgtatttggcacatgatggcttataaattttaactttc

SEQ ID NO: 2293 - DNA, 1930 bp, Rattus norvegicus
  Genbank Accession No. NM_031589
aaaaacacagctcagcagatccgggcactggagagggagctgcaagcaggagcagtcaagagtgtggtcagaagcaccgtgagtggaccagcagggccggctttttctaccatggcggcccaaggctatggctattaccgcactgtcatattcacagccatgttcggaggctacagcctttactacttcaaccgcaaaaccttctcttttgtcatgccctccttggtggatgagatcgctctggacaaggacgatttggggctcatcacgagcagccagtcggcagcctacgccatcagcaagtttgtgagcggggtgctgtctgatcagatgagtgcccgttggctcttctcctctgggctgctcctggttggtctggtcaacgtagtcttctcgtggagctctacagtaccggcttttgctgctctctggtttcttaatggtctggcacaggggctaggctggcccccctgtgggaagatcctgaggaagtggtttgagccatcccagtttggtacttggtgggctgtgttgtcaaccagcatgaacctggctggaagcctgggacctatcttggcgacaatccttgctcagagctacagctggcgcagcaccctggccctgtctgggtcactgtgtgtggttgtctccttcttctgtctcctgctcatccacaacgaacctgctgatgttggactccgaaatctggaccctcgcccctccaagggcaaaaagggctcgtcaaaggaggagagcaccctacaggacctgctgctgtccccctatctctgggtgctctccactggctacctcgtggtctttggggtaaagacttgctgtacagactggggccagttcttccttatccaggagagagggcagtcggcccttgtgggtagttcctacatcagtgccctagaggttggaggccttgtaggcagcattgcagctggctatctgtcagacagggctatggcaaaggcagggctgtctgtgtatgggaaccctcgccacagcctgttgctgctcatgatggctggcatggcagcatccatgttcctcttccgggtaacagtgaccagcgactctcccaagatctggatcctggtattgggagctgtatttggtttctcttcttatggtcccattgccttgtttggagtcatagctaatgagagtgcacctcccaacttgtgtggtacctctcatgctattgtggggctcatggccaatgtgggtggatttctggctgggttacccttcagtaccatcgccaagcactatagctggagcacagccttctgggtggcagaagtgatctgtatagccagcacagttgtcttcttcttgcttcgaaatatccgcaccaagatgggccgagtatccaagaaggcagagtgaaaagagcactcactatagagcatccccaactgcaacctcattggcaggacacagaaaggaagagaggctgctctggctagaacagagcctttacatatctgtgtctacactgtctctctggacctccgtggtgctgcaagttaccagtggctaatgaggtcctatgctctatttaaatgatgtttggttttaggctccattggcttctgtttctaccttctagcagacagacaactcctaaattcagggtgtctcctatacccctcttcctctcctgagtccccatctcctagtgaggtggttctatctctgcagctgcagaatattaatggcctgtggtttctgctgtaccccaaggcttcttgttaggggtcaacactgttgccaatacctcagtccctaagggaggagaggaggccaccactctcatcagttacctggggacaaaagggaggaatgtagagagcaaactgtcttgtatagactaataaaactagatttgatactaaaaaaaaaaaaaaaaaaaaaa

SEQ ID NO: 2294 - DNA, 2532 bp, Rattus norvegicus
  Genbank Accession No. NM_031596
cccattttgcgtcgtctgggttcgggtggcggcccggctccaggcggacgcactaatcatggggtcgtcaaagaagcaccgtggagagaaggaggcagccgggactacggctgcggccggtaccgggggcactaccgagcagccgccacggcatcgagagcacaagaaacacaagcatcggagcagcggcggcggcagcagcggcggcgaacgacggaagcggagccgcgagcgtggggccgagcgcgggagcgggaggcgcggggccgaagccgaggcccgcagcggcgcgcatggtcgtgaacgaagccaagcggaaccctcggagcggcgcgtgaagcgggagaaacgcgatgaaggctatgaggccgctgccagctccaaagccagctctggagatgcctcatcactcagcatcgaggagaccaataaactccgagcaaagttggggttgaagcccttggaagtcaatgctgttaagaaagaggcgggcaccaaggaggagcccgtggcagccgatgttatcaaccccatggccttgcgacagcgtgaagaactacgggagaagctggcagctgccaaggaaaagcgcttgctgaaccaaaaattggggaaaataaagacactgggggaggatgacccctggcttgatgacactgcagcctggatagagaggagccggcagctacagaaagagaaggacttggcggagaagcgggccaagctgctagaagagatggaccaagagtttggtgtgagcactttagtggaggaggagtttgagcagaggcgacaggacctgtacagcgcccgggacttgcaaggcctcaccgtggaacatgcaatcgattcctttcgagaaggggagactgtggtcctcactctcaaggacaaaggggttctgcaggagggggaggatgtgctggtgaatgtgaacatggtggacaaggagcgagcagacaagaacgtggaacttcggaagaagaagcctgactacctgccctatgtggaggacgagagtgtggatgacttggcacagcaaaaacctcgctctatcctggccaaatatgatgaggaactggagggcgagcggccacattccttccgtttagagcagggtggcatggccgatggcctgagagaacgagagctcgaagaaatccggaccaagctacggctgcaggctcagtctctgaacactgtagggccccggcttgcctctgagtacctcagtccggaggagatggtgactttcaaaaagaccaaacggagagtgaagaaaatccgaaagaaggagaaggaggtaataatgcgggcagatgacttgctgccccttggcgaagaccagactcaggacggggactttggatccaggcttcggggccggggtcggcgccgagttcctgaagtggaggaggaggcccttgaggatgaagagaaggaccctgtggcccagccgccaccatcagatgacactcgcgtagagaacatggacatcagtgatgaggaggatgggggggctcttccctcggggcccccagagctggaggaggacgaagcggagctggagctgcagaagcagctggagaaggggcgccggctgcggcagctgcagcaactgcagcagctgcgggacagcggtgagaaggtgctggagattgtgaagaaactggagtctcgccaacgtggctgggaagaggaagaggatcctgagcggaaggggaccatcgtgttcaatgccacttctgagttctgtcgcactctgggggaaatccccacttacggattagctggcaaccgagaggagcaggaggagctcatggactttgaaagggatgaagagcgctcggccaatggtggctctgaatcagatggcgaagagaacattggctggagcaccgtcaacctggatgaggagaagcaacatcaggatttctccgcttcctctaccaccatcctggatgaagagcccattgtgaacagagggctggcggctgccctgctcctgtgtcagaacaaaggactgttggagaccacggtacaaaaggtggcccgagtaaaggctcccaataagtcactgccttcagcagtgtactgcatcgaggataagatggccattgatgacaagtacagccgacgtgaggagtacaggggcttcacccaggacttcaaggagaaggatggctacaagcccgatgttaagattgaatatgtggatgagacgggcaggaaactgactcccaaggaggcattccggcagctgtcccaccgcttccatgggaagggctcagggaagatgaagactgagcggcggatgaagaagctggatgaggaggcgctcctaaagaaaatgagttccagtgacacgcccctgggaaccgtggcactgctccaggagaagcagaaggctcaaaagacaccgtacatcgtgctcagtggcagtggcaagagcatgaatgcgaacaccatcaccaaatgaagcacctccctgtcccagatgtaatgttaaataaagttcccgccttattttta

SEQ ID NO: 2295 - DNA, 1771 bp, Rattus norvegicus
  Genbank Accession No. NM_031603
ctaaagcggacgcggagcgagaagctgagagagtcggagacgctatccgcttccatccgtcgtgcagaccctgccggagccgctgccgctatggatgatcgggaggatctggtgtaccaggcgaagctggcagagcaggccgagcgatacgacgaaatggtggaatcaatgaagaaagtagcaggaatggacgtggagctgacagttgaagaacgaaaccttttatctgttgcatataaaaatgtgattggagccagaagagcatcctggagaataatcagcagcattgaacagaaggaagaaaacacgggaggagaggacaaattaaagatgattcgggagtaccggcaaatggttgaaactgagctcaagttaatctgttgtgacattctggatgtactggacaagcacctcattccagcagctaacactggcgagtccaaggtttcctattattacatgaaaggggactaccacaggtatctggctgagtttgccacaggaaacgacaggaaggaggcagcagagaacagccttgtggcttacaaagctgctagtgacattgcgatgacagaacttcctccaacgcaccccattcgtttaggtcttgctctcaacttttccgtattctactatgaaattcttaattcccccgaccgtgcctgcaggttggcaaaagcagcttttgatgacgcaattgcagaactggacacgctgagtgaagaaagctataaggactccacactcatcatgcagctgctacgtgataacctgacgctgtggacctcagacatgcagggcgatggtgaagagcagaataaagaagcgctgcaggatgtggaagatgagaatcagtgagacgtaataaagccaacaagagaaaccatctctgactaccccaccccacccctgcccttggaagttccccattgtcactgagaaccaccaaatttgactttcacatttggtctcagaatttaggttcctgccctgttgttttgctttcgttttcttttttttctcccctccccctttttaaaacaaacagttttcagaagttcttaagccaagagtgaatttctgtggattttactggtcccagctttaggttctttacgacactaacaggactgcatagaggctttttcagcattactgtattgtctccggccacatgtggcaagatcatcattagaaatggaaatgacatttgagagccattagacttctaggtgatgcatctaagaaagattaatcacacaatagaggctattgcgctgtcatttttcctttttttaattgttaaattgaattttataccaatgtttaaacttaaattgggtgttagcttgaggtgttttgggggagtttgcggtaatggttttgctgtaacgtgtgtttggaactctgctgaagggctgctgaaaagcacggtgctggtaacagtccaacagtccgcggctgctcattcttgccgactcctccctctgacgcaggttagcattgaaggtggtatggaagcctgcatgcgtgttcaactcttcctcttccctcctcctcggcctccctcatcccttcctccttcgctcgctcaacctcttttgttcagtatgtgtaacttgaagctaatttgtactactggatatctgactggagccacagatacagatctgtattgttcttactgaaacacagcatggaattaacattaaacttaaataaaacaaacctaaattaaagatgcacaaaaaaaaaaaaaaaaactttagag

SEQ ID NO: 2296 - DNA, 3876 bp, Rattus norvegicus
  Genbank Accession No. NM_031604
ctcagattggagtgaacaaccatcgccaccatgggggagcttttccgaagcgaggagatgaccctggcccagctctttctccagtccgaagctgcttattgttgtgtcagtgaattagaagaacttggaaaggttcagttccgggatttaaatccagatgtgaatgttttccagaggaaatttgtgaatgaagttagaagatgtgaagaaatggatcgaaaactccggtttgttgagaaagagataagaaaagctaacatcccaattatggacactggagagaacccggaggtgccctttcccagggacatgatcgacttggaggccaatttcgagaagatcgaaaacgaactgaaggaaatcaacactaaccaggaagctctaaagcgaaacttcctggaactgactgaattaaaatttatactgcgcaaaactcagcagtttttcgatgagatggcggatccagacctgttggaagagtcctcatcactcttggagccaaacgagatgggaagaggcgcgcctttacgacttggcttcgtagctggtgtgattaaccgggaacggatcccgacctttgagcgcatgctttggcgagtgtgccgagggaatgtgttcctgagacaggctgaaatcgaaaacccgctggaggatcccgtgactggcgactacgtgcacaagtccgtgttcatcatttttttccaaggtgaccagctgaaaaacagggtcaagaaaatctgtgaagggttccgagcctccctctatccctgtcctgagactccacaggagagaaaagaaatggcttccggagtcaataccaggatcgacgatctccaaatggttctgaatcagacagaggaccaccgccagagggttctgcaggcggctgctaagaacatccgggtgtggttcatcaaggtgcggaagatgaaagctatctaccataccctgaacctctgcaacatcgatgtgacgcagaagtgcctgatcgcggaagtctggtgccccgtcactgacctggactccatccagtttgcactgcgaaggggcacggagcacagcggttccactgtcccctccattctgaacaggatgcagacaaaccagacaccccctacgtataacaaaaccaacaagttcacgcacggcttccagaacatagtggatgcttatgggatcggcacttaccgagaaattaacccagctccgtacaccgtcatcaccttcccctttctgtttgctgtgatgtttggagattttgggcacggcattttgatgactctgtttgctgtgtggatggtgttgagggagagccggatcctctcccagaagaacgagaatgagatgtttagcatggtgttcagcggccgatacattatccttctgatgggactgttctccatctacactggactcatctacaatgactgcttttccaagtctctgaatatctttgggtcatcatggagcgtacggccaatgttcaccatagggaactggacggaggagacgctcctggggagttctgtcctccagctgaacccagctatccctggagtctttggtggcccttacccatttggcattgatccgatttggaacatcgcaaccaacaagctgaccttcctcaactccttcaagatgaagatgtcagttattcttgggatcatccacatgctgttcggggtcagcctgagccttttcaaccacatctatttcaagaagcccctgaacatctactttggctttattcccgagataatcttcatgtcctcgctgtttggctacctggtcatcctcatcttttacaagtggacagcctacgatgcccactcgtctagaaatgccccgagcctcctgatccatttcataaacatgttcctcttctcctacccagagtctggtaacgcaatgctgtactctggacagaaaggaattcagtgtttcctcatagtggtggcaatgctctgtgtcccctggatgctgctgtttaagccgttgatccttcgccatcagtacctgaggaagaagcatttgggaactctcaactttggtgggatcagggtgggcaacggaccgacagaggaggatgctgaaattattcagcatgaccagctctccacccattcagaggacgcagaagagcctaccgaggacgaagtgtttgactttggcgacaccatggtccaccaggccatccacaccattgagtactgcttgggctgcatctccaacactgcgtcctacctgcggctctgggccctcagcctggcccatgcacagctctctgaagtactctggaccatggtgatccacatcggcctgcatgtccggagtctggcagggggactggggctgtttttcatcttcgctgcctttgccaccctgaccgtggccatcctgctgatcatggaaggcctctcagccttcctccacgcactgcgattacactgggtggaattccagaacaaattctacactgggactggtttcaagttcctccccttctcctttgagcacattcgggaagggaagtttgatgagtgagtctcaggcagggcgcatgctcagagcagctctcctgcctgcctctacagtgactgtgtctcttgcctgctggttgtgatccctggatactcgggcgtttgtgtcaccctacaacccctgtccccgctgtgactcatttaggttgtgctggccttccctgggtctctttctcccaagccttgggtgttacgtacagactttcgactgagagctggatggctgtgcctgatacccacccatccccatggcaccacttggcctcctggcctccagacagatagccctattccatcccctaatggtgagccaacctgcacagacacataggggcacggagccctcaggatgcaaggggtccctcatcagtccaggagttcttggtcacgccttggaggaagatggcaatgggttctctcctagaaggggatattgcttatggaacatacccgactccgctggcagggacagtcaggaagatgctgctgtcaccctttgtccagcctctccagtgagtattcaggaaactcagttggccctacctgggccatctcaaaggttccaggataacccccaccctcctagcccccaccctcctaaacactctcctcccccagccctgttggcacagcatagctagcatccgtagaatgggagggtcgcactgacttgcagcaccgggcttccggaccttagattcccttctctgtcagtgcgtgaatgggccttgccaacactacaccccaaggcagaagttaaaattggcacactcccggcatatccctgagcccttctgcaccctgatcatgatgtcctgaggctgtggtcagtaaggttggttctgccggcaggcctgccttgatctgcccacttattactccctctccaatccccatgctgaccccaggtttcaggagtggcgtcctggacagggaaggtcagtgtcatttacaatttgctaatcagaggcgactgttgggctaccagagcagatgtgggagcgctgctaagcccttgccgcctacctcatgtactgtggatctcagacccttctaatcatgtgctgactcccgaaattcactcactgccttccctgtggaggtaatactaaatcagcaaggcccctcccctcccccaccctggcgctcttgagccgctcccacggtgaattgttcagagcccctctgtccttttgtgcccagtttacatgatgatctctgctgtttacagagaggcccacagcagaggtctctgtggggaccctgcccaaggccttctgttcagacattcttatccggaataaagtgtgtttgactctgacaaaaaaaaaaa

SEQ ID NO: 2297 - DNA, 1212 bp, Rattus norvegicus
  Genbank Accession No. NM_031606
atgacagccatcatcaaagagatcgttagcagaaacaaaaggagatatcaagaggatggattcgacttagacttgacctatatttatccaaatattattgctatgggatttcctgcagaaagacttgaaggtgtatacaggaacaatattgatgatgtagtaaggtttttggattcaaagcataaaaaccattacaagatatacaatctatgtgctgagagacattatgacaccgccaaatttaactgcagagttgcacagtatccttttgaagaccataacccaccacagctagaacttatcaaacccttttgtgaagatcttgaccaatggctaagtgaagacgacaatcatgttgcagcaattcactgtaaagctgggaaaggacggactggtgtaatgatttgtgcatatttattgcatcggggcaagtttttaaaggcacaagaggccctggatttttatggggaagtaaggaccagagataaaaagggagtaactattcccagtcagaggcgctatgtatattattatagctacctgttaaagaatcacctggattacagaccagtggcactgttgtttcacaagatgatgtttgaaactattccaatgttcagtggcggaacttgcaatccccagtttgtggtctgccagctaaaggtgaagatctactcctccaactcaggacccacgcggcgggaggacaagctcatgtactttgagttccctcagccattgcctgtgtgtggtgacatcaaagtagagttcttccacaaacagaacaagatgctcaaaaaggacaaaatgtttcacttttgggtaaatacgttcttcataccaggaccagaggaaacctcagaaaaagtggaaaatggaagtctttgtgatcaggaaatcgatagcatttgtagtatagagcgtgcggataatgacaaggagtatcttgtgctcaccctgacaaaaaatgatcttgacaaagcaaacaaagacaaggccaaccgatacttctctccaaattttaaggtgaagttatacttcacaaaaacagtagaggagccatcaaatccagaggctagcagttcaacttctgtgactccagacgttagtgacaatgaacctgatcattatagatattctgacaccactgactctgatccagagaatgaaccttttgatgaagatcagcattcacaaattacaaaagtctga

SEQ ID NO: 2298 - DNA, 1788 bp, Rattus norvegicus
  Genbank Accession No. NM_031609
gcgcctcgccccgcccggggccgcagacggccagcagcgacagacagccgagcctcgcggggccgtcccagcccgaggaccccgggcctgcgacccccgcggctcgcatcccactttctaagacctctaagaggacgcgccggcctcttcgcggccaccgcgcgcgttccagggctccggaggtgacaggcacaatgctttgggtcctggtggggactgttctccctgtcatgttgctggctgccccaccacccatcaacaagctggccctgtttccggacaagagtgcctggtgcgaagccaagaacatcacgcagattgtgggccacagcggctgtgaggccaagtctatccagaacagggcgtgcctaggacaatgcttcagttacagcgtccccaacaccttcccgcagtccacagagtccctggtgcactgtgactcctgcatgccggcccagtccatgtgggagattgtgaccttggagtgccccggccacgaggaggtgcccagggtggacaagctggttgagaagattgtacactgcagctgccaagcctgcggcaaggaacccagtcatgagggcctgaacgtctacatgcagggtgaagatgggccaggctcccagccaggatcgcactcccactcccatccccaccctgggtgccagacccctgaacctgaagaacctcctggagcccctcaagttgaggaagagggggctgaggactgagggcccccaactcttcctcccctcttgtcccctgtggaatgtctggtcccaccctccagggaagagggaggggagaggcagaggcccccctccccctctggcactagatggacttggaatgttgcctggttgccatggagatctgaagggaggggctggagccaagctgcacgatttaatatatgcaagatgaggggaggaagcagacatctttgggacttttcttttggaaggtgaagtgtggtctttcctttcagccttctggagaggagccctctggatagagaggaagcaggttgagctgctgaggatgactgagatcctcagatagggcaggcccaggtcaggacccagacaacggatggggcaggatccccagtgacgggcagagggtgggtatcatgtcagcatcccctttgcaggaggatctaggtaggaagacagctggcagaagtcggaaactccagccccataggtttccctaaaggcctcccctcatgtaaccccttcaatggagtggcttaggagtcaggctggggcaggaccctgctgactcaggtgccagagtgtcactgaagaagaaagaagatccctctcccccacaccctgtccctccctccagagatcttagctctttgctctccccaagttctggactcttctgaaaacagctgcaaccggtcctgccgtccttggggctggtctttctgaaagaggtgacagtttatccccatcacctgggaccgtagtggacaggaggcccctgcctagggcccctgctgacctcagctttctctagctccttattctatccactccttcttcccagctgcactttaaccttagggcagggcaggtggcgaggaagggccctctgtctccttatctgctggcaccattgtgtccagggggttgccagctcaccccctccctgggggtgccccagcccatggctgtttgacgagagccttagagcttgtaactagtagccatctcccctgaacctgagtgtttccatgaataaaatgccttcaacgcctctacaaaaaaaaaaaaa

SEQ ID NO: 2299 - DNA, 3360 bp, Rattus norvegicus
  Genbank Accession No. NM_031614
gccttgcagcggcgcgggcaaacggagaggccgcgggaggcgcgaagccggcagaaggcgagggagagcggagggcggccatggtccagccctgaagccaaacaaaaaaggcctacttcgaaagctgtcaacaatgaatgactctaaagatgcccctaagtcctatgacttcgacctgatcatcattggaggaggctcgggaggcctggcggcagctaaggaggcagccaaatttgacaagaaggtgatggtcttggacttcgtcacaccaactcctctcggaacgaatgggggtctcgggggaacgtgtgtgaacgtgggctgcatacctaaaaaactgatgcaccaggcggctctgttaggacaagctctgaaagactcacgcaactatggctggaaactcgaggacacagttaagcatgactgggagaaaatgacagaatctgtgcagaatcatatcggctcgctgaactggggctaccgagtagctctccgggagaagaaggtcgtctatgagaatgcttacgggaaattcattggtcctcacaaaattatggcaacaaataacaaaggtaaagaaaaagtttactcagcagagcggttcctcattgccaccggtgaaaggccacgctacctgggcatccctggagacaaagagtactgcatcagcagtgacgatcttttctccttgccttactgcccggggaagaccctagtggttggcgcgtcctatgtcgccttggaatgtgcaggattcctggctggtatcggcctcgacgtcactgtaatggtgcggtccattctccttagaggatttgaccaggacatggccaacaaaattggtgaacacatggaagagcatggtatcaagtttatcaggcagttcgtgccgacgaaaattgaacagattgaagcagggacaccaggccgactcaaggtgaccgctaaatccacaaacagtgaggagaccatagaagacgaatttaacacagtgttgcttgcagtaggaagagattcttgtacaagaactattggcttagagaccgtgggcgtgaagatcaatgaaaagaccgggaagatacctgtcacggatgaggagcagaccaatgtgccttacatctacgccattggtgacattctggaggggaagctggagctgacccccgtggccatccaggcggggagattgctggctcagaggctgtatggcggctccactgtcaaatgtgactatgacaatgtcccaacgactgtgtttactcctttggagtatggctgctgtggcctctctgaagaaaaagctgtagagaaatttggggaagaaaatattgaagtttatcacagtttcttctggccattggaatggacagttccatcccgggataacaacaaatgttatgcaaaagtcatctgtaaccttaaagacaacgaacgtgtcgtgggcttccacgtactgggtccaaatgctggagaggtgacgcaggctttgcagccactcaagtgcgggctgaccaagcagcagctggacagcaccattggcatccacccggtctgtgcagagatatttacaacgctgtcggtgactaagcgttctgggggagacatcctccagtctggctgctgaggttaagccccagtgtggatgctgttgccaagactacagaccattgcttgcttccttgtccacacccaggtgaagttcaggaaggctcttgggttcttggcaccaattcaaggtgctatcctaaggccaccaggtccctgggatcttgtgggtaggaggtggcaggtagaagaaggctgcagcatcgcactggggtcaccatgacggactcagactgacattcggcagagcatcacggtgcgtccatgaagtcactagcctcaagcccaagtggtgggcagtgacagaaagctgtcgatctgttgggttcaacctttccctgtagactgttttagtctcgccttcaagctatgtaatgtcaattctgttttttcttttctccatggggttaatgatactagaggtagggaatgttagcaatcagtttttgtcatggctggactatccacagcacggtcgttactgtgtggaagggggtcagatggcttatgagagccaaaccagtttatcctgagaaagacgaattaccctgtggctaaaatacactgtttttactaacctgtgtagcattgtcccctttaataagtttaggtcttctgtccaaactgagaaaaaccatggtcactttggcaaatttccggcagtgtgtgtccctgccgctgcttagcaagggcggcggtgacttggctaatctactcagactcattgcatggctcttgggtatcatggagtattccagcatagagcctgaccagcagtaaatgtctctcctggtacagttactgtctgctggactaagtgcgctgagatggttctcaatggagaatgcttaatttgcttttaacctcttgtttttgtgaggtgggtttagttttaagcttatgtcccataagaactccattcacaggcaagcagctctttccgcacacagcatatgcatcttctgaggtaatggctttataaggaagctgttcataacataagttattattattattgaacacaggtggatgtgaaggattttttttcattgaagaaccaaatggtttttcttttttctgttcagtgagcccacagagaccctggcaggaacagcattgctggcagcattgctgctgggcttttccagtgtagttcttgctcctaggtcacgtgacagcgaacacgatgcctgaggaccgcgcagacaggtttcccaccgcacagccgcccaaggtcccgccatggtccggtagctccttttcttgtcctcccctctgcccatctccacctgcagtactgagtggcgtttcccagtaccctttggggccacctcagggaacgggtttgcctggtattcagccagcggcacccaccctgccccacgaggctccctcagatccgccccacatccgtgtgttgaagaggagaaaggaccagggaaccaaaggagtggactgttgagttttatttatttattttttgtttttttttctcctaagtctgccagtctctgagatcagaacgacagtgtagggtagccgcctaatcatgttgtgattctattggtgggatgaaatgttccgcccccatggaaggagtacactcgtcgtttatgttctgtaatcgcacaatgtactgtaacccaaattccaattccatgtatttttattacagtttctctgggaaaaaaaaatgtgaaacaataaaaaggtgttgattcacgaaaaaaaaaaaaaaaaaaaaaaaaaaaaaaa

SEQ ID NO: 2300 - DNA, 3662 bp, Rattus norvegicus
  Genbank Accession No. NM_031622
agacctgccgggcgcatatttattcacagttttgtcccatgttaagtcggttagcatagtgaatctgagtgcatagtatgtcatttcattccgttgagtttctcgagtgttttctttaaatgtctgcagagtcgctacccttccttgaactatgaagcactgcaatcttcttaattctcagtatgaagagagatttttgagctttaagtctgaggggaactcagcaggcctggttggcgtctgcaatgaacatcaagaaaccatcgtgctgtgggaatgtgatcgtttttctccctttttgagagatctttccttttgatgccagttttcttccttgtttacacaagttcaacaatttgaaaggaaaaggcaattgtaagggttttaaaatggcagagaaatttgaaagtctcatgaacattcatggctttgatctgggttccaggtacatggacttaaaaccattgggctgtggaggcaatggcttggttttttctgctgtagacaatgactgtgacaaaagagtagccatcaagaaaattgtcctcaccgatccccagagtgtcaaacatgccctccgtgaaatcaaaattattagaagacttgaccacgataacattgtgaaagtgtttgaaattcttggtcccagtggaagccagctgacagacgatgtgggctctctaacagagctgaatagcgtctacattgttcaggagtacatggagacagacttggcgaacgtgctggagcagggccctttactggaggagcatgccaggctcttcatgtaccagctgctgcgtgggctcaagtacatccactctgcaaacgtgctgcacagggatctcaagccggccaaccttttcattaacactgaagacttggtgctgaagattggtgactttggcctggcccggatcatggatcctcattattcccataagggtcatctttctgaaggattggttaccaaatggtacagatctccacggcttttactttctcctaataactatactaaagccattgacatgtgggctgcaggctgcatctttgctgaaatgctgactggtaaaaccctctttgcaggtgcacatgaacttgaacagatgcagctgatcttggagtctatccctgttgtgcacgaggaagatcggcaggagcttctcagcgtgattccagtttacattagaaacgacatgactgagccacacaaaccgctgactcagctgcttccggggattagtcgggaagcactggatttcctggaacagattctgacgttcagtcccatggaccggctgacagccgaggaagcactttcccatccttacatgagcatctactctttcccaacggacgagcctatttccagccatcctttccacatagaagacgaagtggacgacattttgctaatggatgaaacacacagtcacatttataactgggaaaggtaccacgattgtcagttctcggagcatgactggcctattcataacaactttgatatcgatgaggttcagcttgacccgagagctctgtctgatgtcaccgatgaagaagaagttcaagttgatcctcgaaagtacttggatggagaccgagagaagtatctggaggatcccgccttcgacaccagctactctgctgagccttgctggcagtacccagatcaccacgagaacaagtactgtgatctggagtgtagccacacctgtaactacaaaacaaggtcgccatcatacttagataacctggtgtggagggagagcgaggttaaccattactatgagcccaagcttattatagatctttccaactggaaagagcaaagtaaggacaaatccgacaagagaggcaagtccaagtgtgagaggaacgggttggtcaagcgcagattgcgcttgaggaagcgtcccagcagctggctgagagggagaggggccaaggctttgactttgatgccttcatcgcaggcaccgttcagctcagtgcccagcgtgagtctgctgacgtagttgacaagttaaacgacttgaatagctcagtgtcccagctagaaatgaaaagcctgatatccaagtcagtcagccgagaaaagcaagaaaagggaagggctaacctggcccagctgggagccttgtaccagccctcctgggagagccagtttgtgagtggcggggaggagtgcttccttatcagtcagttttgttgtgaggtcaggaaggacgaacacgtggagaaggagaacacttacaccagctatttggacaagttttttagcaggaaggaggattctgaaatgctagaaactgagccagtggaagaagggaagcgtggggagagaggccgtgaggcagggcttctgagcagcggtggggagtttctcctgagcaggcagctagagtccataggcaccccgcagttccacagtccagggggatccccactcaagtccatccaggccacgttaacaccttccgctatgaaatcttcccctcaaatccctcacaagacatacagcaacattctgaaacatctgaactaaacactcagcagacacttcttttgttcttcatgaaatgtgttgtgtcttttttatcactaatgttttaagtcattttttttttacttgaatcagaaggtgtcattaatttgcaaggatttttcttggttctcagtttgtaaaacacagagttttttctacatgtgagttagttttcatttgaactggcatgtcgtttgcacacacacaaagaatagagcaaaacaatgcagtgcaggaggagacaagatgcgctaggatggacagacattctcacagaccagtgacctgcttacaggaaacaaaaccttgccttgaaacttacacagtgagactgtacataattgcatgaaaagatctatttttttcctgaaacatttttcattcattagtattttcaagtttttcatactgtacacatttcttaagacacatgataccagcagcaactgaaaacgaatgccgaatttggtacacatgtgttatctacctcaaggtaacaaaagtatgcgggcgaaacctaacccacccatagtcgtccgcggcatatgcacttgtatctagccagcgttggccgcagtaaccaatgagactcgtccgccatttatcaatgtcctggtgttcatcctttacagtgaagtgttagatacatcacatcttatttatttttagcaaatcagtatattttctgtatttaattataaaaggtaacttagtttaagtttatttgcaactgcccttcttcccgtttggcactatggtttgttgcctgccgagctgatctgagaagtcagcttgtcccgaggctgtccatgtacgttaagtaaagtgctcactgtgtataggaatctgtattttggaggtgcttgatctatctacaaagaaaaaaattaggaatttattataaaatgctcctagaagtcttaatggtgtttattttttaaaaccttgtaatgttagacttgtgtgcatggaagtgattaaggtacatcattattgtagtttgaacattgtacatgataagccttcccccacccccgtttttactgtatgtttttattgaatgatctattccccatccctaggcaagcatgaataaaattaggttaaatgt

SEQ ID NO: 2301 - DNA, 1950 bp, Rattus norvegicus
  Genbank Accession No. NM_031623
gctggaccccagcctttcttcgctttcgcctcgcggtcgatgactccctagaccccctggcctacgatcatgaccacgtccctgcaagatgggcagagcgccgcgggccgggcgggcgcccaggactccccgctggcagtgcaggtgtgccgcgttgcccagggcaagggagacgcccaggacccggctcaggtccccggactgcacgcgctgtccccggcctcagatgcgacccgccgcggtgccatggacaggagaaaagcgaaagatctggaagttcaggaaacgccttccattcctaaccccttccctgagctctgctgttctccacttacatcggtgctgtcagcaggcctcttccccagatcaaattcaaggaagaaacaggtgattaaagtttacagcgaggatgagaccagcagagcgttagaggtgcccagtgacgtcacagcccgtgatgtctgccagctgttgatcctgaagaaccactatgtcgacgacaatagctggaccctttttgagcacctgtctcacacaggcgtagaaaggacagtggaggaccatgagctgctgactgaagtgctgtctcattgggtgatggaagaagataataagctgtatcttagaaagaattatgccaaatatgaattttttaagaacccaatgtatttctttccagagcacatggtgtcttttgcaactgaaatgaacggtgacagatcccttacacagatcccgcaggtgtttttaagctcaaacacatatcctgaaatccatggcttcctgcatgcaaaggaacaggggaagaagtcttggaaaaaagcttacttttttctcagaagatctggtttatatttttctactaaaggcacatccaaggaaccacggcacttgcagtttttcagtgaattcagcactagtaatgtttacatgtcactggcaggcaaaaaaaagcatggagcgccgactccctatggattctgctttaagcctaccaaagcaggagggccccgggacctgaaaatgctgtgtgcagaagaagaccaaagcaggatgtgctgggtgaccgccattagattgctcaagtatggcatgcagctctaccagaattatatgcatccatcccaagctagaagcgcctgcagttctcagagcgtatcacccatgagaagcgtatcagagaattccctagtagcaatggacttctcaggtcagaagaccagagtcatagacaaccccactgaagccctttcggttgccgttgaggaaggactcgcttggaggaaaaaaggatgtttacgcctggggaatcatgggagtcccactgcgccctctcagagctctgctgtgaacatggctctccaccggtcccagccatggtttcaccacagaatttctagagatgaagctcagcagttgattacccggcaggggcctgtggatggagttttcttggtacgggatagtcagagtaaccccagaacttttgtactgtcaatgagtcacggacaaaagataaaacactttcaaattatacccgtggaagatgatggtgaggtgttccacaccctggatgatggccatacgaagttcacagatctcatccagctcgtggagttctaccagctcaacaagggggtccttccttgcaagctgaagcattactgtgctaggatggctgtttagccaaactgtctgtgactcgttaaactatggaagatggaggatgcaaagaagaatgattagagagagagagagagagagagagagagagagagagagagagagagagagaggagatcacaaggctggaaacaaatcatggtgaaaagaagattcacctgtgggttacaaaaaaataggtcacgtattgcaaattagtgaagacttggattcgtattactctcgttactttaaatttattagttaaaattaaaccttattaaaaaa

SEQ ID NO: 2302 - DNA, 1239 bp, Rattus norvegicus
  Genbank Accession No. NM_031624
caagatggcagcgtctgaagaagagttactgctgccgcggcttccggagctcttcgaaaccagcaagaaacttctggaggagttggaagtagcaactgaacccaccggctcccgaacaatccaggataaggtgtccaaaggactagaactccttgagaaggctgccggaatgttatcgcagcttgatttgttcagccgaaatgaagatttggaagagattgcttctatcgacctgaagtacctgatggtaccagcgttgcaaggagctctcaccatgaaacaagtcaaccccagcaagcgtctagatcatttgcagcgggctcgagaacacttcatacatttcttaactcagtgtcattgctatcatgtggcagagtttcagctaccccaaaccaagaataactcagctgaaaataatactgctcgctcctccatggcctatccaaatctcgttgctatggcatctcaaagacaggctaaaatagagagatacaagcagaagaaggaggtggagcataggttgtctgcactgaaatctgctgtggaaagtggtcaagcagatgatgagcgtgttcgtgaatattacctccttcaccttcggaggtggattggtatcagcttagaagagattgagagcattgaccaggaaataaagatcctgaaagacaaagactctccaagagaggaatcagcttgtcagtcatctcttccagagaagcctccaatgaaacccttcatcctcactcggaacaaggcacaagccaaagtatttggaactggttatcccagcctggcaactatgacggtgagtgactggtatgaacagcatcagaagtacggagccttaccagatcggggaatagccaagccgccatcagctgattttcaaagagcagctcagcagcaggaagatcaagagcaaaaggatgaagagaatgaggagaaagccttgcacaggatgcgagagtgggatgactggaaggacacgcatcccaggggctatggcaaccggcagaacatgggctagtcattccagaaggccaaaggacaacgtggtgcacaccttcacaccaaggacaacttcaggagggtgcagtgagggcagccatgtggagtcttgcattgcatttgatagtgtcaaataattgcttgtaccctaggtaatgaccagtgaatttttgtttggctttattaatttcaaaaaaaaaaaaaaaaaaaaaaaaaaaaaaaaaaaaaaaa

SEQ ID NO: 2303 - DNA, 4400 bp, Rattus norvegicus
  Genbank Accession No. NM_031628
ccgagtctcctgcctcccgccccccacccctccagcgcctgctcctcctccgctccccatacacagacacgctcacacccgctccttcacttgcacacacagacacacgcgcgctcacacgctccgcacacacactccactctctcccgcgcgctcacacccctctctctcggcgccctcgccggtgtcgcgccgcgccgcgccgcagccggacgcccctccagggctcactttgcaacgctgacagagcgggcagtggccgtggaggtgggaaacgtggcgacatcctagcccctggtcgcagccggagactggacgctgcggaacctctcggcggcgctctcccatgagttgggatcgcagcatccccagccagccgctgctcaccgcctctgggagccgctgggtttgtgcaccgcagcccttccgggacagcagctgtgactctcccccaatccagatttcggggtcgctctctagaaactcgctctaaagacggaacctccacagaacccaaagcccactgcgggagagcgcagcccgacaagcccgggcgctgagcctggaccctcaacagagcgggccagcacagcggcggcggctgcttcgcctatcccgacgtccccgcctcctacactctcagcctccgctggagagacccccagccccaccattcagcgcgcaagataccctccagatatgccctgcgtgcaagcccaatatagcccttcgcctccggggtccacttatgccacgcagacttatggctcggaatacaccacagaaatcatgaaccccgactatgccaagctgaccatggacctcggtagcacggggatcatggccacggccacgacgtccctgcccagcttcagtaccttcatggagggctaccccagcagctgcgaactcaagccctcctgcctgtaccaaatgccgccttctgggcctcggcctttgatcaagatggaagagggtcgcgagcatggctaccaccaccaccaccaccatcaccatcatcatcaccaccaccaccagcagcagcagccgtccattcctcctccctctggccccgaggacgaggtactgcccagcacctccatgtacttcaagcagtctccgccgtctacgccgaccactccaggcttccccccgcaggcgggggcgctgtgggacgacgagctgccctctgcgcctggctgcatcgctccgggaccgctgctggacccgcagatgaaggcagtgcccccaatggccgctgctgcgcgcttcccgatcttcttcaagccctcaccgccacaccctcccgcgcccagcccagccggcggccaccacctgggctatgaccccacggccgcagctgcgctcagtctacccctgggagccgcggccgccgcgggcagccaagctgctgcgctcgagggccatccgtacgggctcccgctggccaagaggacggccacgttgaccttccctccgctgggcctcacagcgtcccctaccgcgtccagcctgctgggagagagccccagcctaccatcgccacccaataggagctcatcatccggcgagggcacgtgtgctgtgtgcggggacaatgctgcctgccagcactacggagtccgcacctgcgagggctgcaagggcttcttcaagagaacggtgcagaaaaacgcaaaatatgtttgcttggcaaataaaaactgcccggtagacaagagacgtcgaaatcgatgtcagtactgcaggtttcagaagtgtctcagtgtcgggatggtgaaggaagttgtgcgtacagatagtctgaaagggaggagaggtcgtctgccttccaaaccaaagagcccactacaacaggagccctcgcagccctccccaccatctcctccgatctgtatgatgaacgcccttgtccgagctttaacagacgcaacgcccagagaccttgattactccagatactgtcccaccgaccaggccactgcgggcacagacgctgagcacgtgcagcagttctacaaccttctgacggcctccatcgacgtgtccagaagctgggcagaaaagatccccggattcactgatctccccaaagaagatcagacgttacttatagaatcagcctttttggagctgttcgttcttagactttctatcaggtcaaacactgctgaagataagtttgtgttctgcaatggacttgtcctgcaccgacttcagtgccttcgcggatttggggagtggctcgactccattaaagacttttctttaaatttgcagagcctgaaccttgatatccaagccttagcctgcctgtcagcactgagtatgatcacagagcgacatgggttaaaagaaccaaagagagtggaggagctatgcaacaagatcacaagcagcttaaaggaccaccagaggaagggacaggctctggagccctcagagcccaaggtccttcgcgcactggtggaactgaggaagatctgcacccagggcctccagcgtatcttctacctgaagctggaggacttggtgtccccaccttctgtcatcgacaagctcttccttgataccctgcctttctgagcaggggaagcctgagcagagagctacttgctctgctggcactggtcattaagtgagcaaaaggatgggtttgaacacctgcccctctatccttcctccaggggaaaaagcagctcccatagaaagcaaagacttttttttttcctggcacctttccttacaacctaaagccagaaaccttgcagagtattgtgttggggttgtgttttatatttaggctttggtgggtgggctgggagggggtaaaatagttcatgaggcttttctaagaaattgctgacgaagcacttttggatgatgctatcccagcagtggggtggggagaaaggataatataactgttttaaaaactctttccgggggaatatgactatggttgctttgtatttaaaaataagaacagccaagggctgttttaccagggtagggctgtgtcttaagactgatccctttagtatgtacttcccggatcgaggcacataagtggtgcaaatgaggcggggaaattcttcatttcttcatttctttcttcttcttaaaataaaatggcaaaaaaaaaaagatggaagattatctacaaatcagacttagcaaaatgataatggctattcgcttccacatacaagtgcaattttttagagtgctgtcttactaagtcttgtttgtgaactctccctcattttatatgaaaataagaaggaggcagtcatgttatcaaacggcgtgctcattttcctagctcacccttggtccacctgccctgtagaacccttcggaggtatggcccttctaagactttcaggccactcttgatggaattcgacacccctcccctcaacccatgactatccagatgtcctgaatggggatcaggttataaaatggattgcatatgactgtgttcgctgtgtgtttgtcaacctggacagagttctctaaaccttctttagttgtagcaagttcctgattcctccattcagaagcccaaggagcattgggtgactcgatcaagggttaaccctaggagaacatgcaaataagtaggaactgggtcagacagggtaagcaccagagatgataaggatttatatataaatatatataaaattaatttttgttattggttatagacaattttggaaagcaagagaatcatctcttttttttttttaaagaggaaaagatagtattgatgtattagcaaagattagtggggtacggttcaacattccgtgtttgtgcccccttttctatgtttctactgttgatggcatattattatgaaatgattcgttgcatagtgtccttatttgtatgaacatttgtatgcacgttctattgtaatcgctttgcctgtatttattgcaagaccaccagctcctggaggctgagttacagaataatcaaatggggtgttcgtggtgacttggatacaccggttagaaattaaataagcatatatatatatataaaaacatagcaggttacatatatatttataatgtgtctttttattaaccatttgtacaataaatgtcacttcccacgcagttattttatcctttgtttgcagtgacctttaaggcagcactgtttagcactttgatatgaaattttttgcttatttttttgctaaattcaaataacgtttgaagatttttaggtctaaaagtctttatattatatacactgtatcaagtcaagatacctttggccgttttgctaagactcaaactttgaatgtcaaaccaatgtcacggtagcttctgttagcttttaatcatttttgctttagtctttttttttaaaaaaaa

SEQ ID NO: 2304 - DNA, 1356 bp, Rattus norvegicus
  Genbank Accession No. NM_031642
ggagactgtcttttccaacccgacatggatgtgctcccaatgtgtagcatcttccaggaactacagattgtgcacgaaacgggctacttctcggctctgccgtccctggaggaatattggcaacagacctgcctggagttggaacgctatcttcagagtgagccctgctacgtgtcagcctctgagataaaatttgacaaccaggaagacctgtggaccaaaatcattctagcacgggagaggaaggaggaatcagaactgaagatttcttctagtcccccagaggactctctgatcagctccggctttaattataacttagagaccaatagcctgaactctgatgtcagcagcgaatcttcagacagttcggaggaactttcgcccacgaccaagtttacctctgaccccattggtgaagtcttagtcaattcaggaaatctgagttcctcggtcatttccacacctccttcttctcccgaagtaaatagggaatcttctcaactatggggctgtgggccaggagacctgccctcacctgggaaggttcgaagtgggacctcggggaagtctggcgacaagggtagtggcgacgcctccccagatggcagaagaagggtacatcggtgccattttaacggctgcaggaaagtttacactaaaagctcccacttgaaagcacatcagcgcactcacacaggagaaaagccttacagatgctcttgggaaggttgtgagtggcgttttgcaagaagtgatgagttgaccagacacttccgaaagcatactggtgccaagccctttaaatgctctcactgtgacaggtgtttctccaggtctgaccacctggccctgcacatgaagaggcatctctgagggagcagaggatgaatcctgtaggctaaaagaggcttccaggctaagaggcggccatggaaggagggatacctgtaccagccaaagcatgccattgcttcctacccagttacctccagaggcctctctttggaaggtcttttgagggctacaaaagtcatgtcagaagcggcatagcacccacggtgcatggtgtttgggtgaccccggactcaccactggtttctaaccttctgagaggctctaagcttttcgccgtgagcatgcgcactgagaatgttaatgggtgggaatgactgactgtatgttgaggatctattactgactgtatggcgaggcagactttttttttccccccttgtggtagcaaatacctgcaagagacagaaaaaaaaagcagtttgaatgttttgtgtgtgaggagtattccaagggatgagttgaccaccaatcatttcctgaagggtgtctgcaccttag

SEQ ID NO: 2305 - DNA, 751 bp, Rattus norvegicus
  Genbank Accession No. NM_031646
tcgcccaaggcgtgatggctccgctccgggtagagcgcgccccgggtggatcacagctcgctgtgaccagcgcccagcggcccgcagcgctccgcctccctccgctgttactgctgctgttgctgctgctgctgggcgctgtctcaacctctccggagtccctgaatcaatctcatcctactgaggacagccttctgtcaaaagggaagatggaggactacgaaacaaatgtcctaccttgctggtattattacaagacttccatggactctgtcaaggactggtgcaactggactttgattagcaggtattacagcaacctgcggtattgcttggagtacgaggcagacaagtttggcctgggcttcccaaatcccttggcagaaagtatcatccttgaggctcacctgatacactttgccaactgctccttggtgcagcctaccttctccgatcccccagaggatgtgcttctggccatgatcatagcccccatctgcctcatccctttcctcgttacgcttgtggtgtggaggagtaaagacggcgatgcgcaggcgtaggctccgcctctcagcagccatcttttccctgtaccctgctggaaccaggatctctcctcccctccctacccacttactcccatccttcccacagaccttcggattggtggaaatggaagaaaggggaactgatagcacaatgtccgtcgtctttaaaataaaatatgtttttgtaaaaaaaaaaaaaa

SEQ ID NO: 2306 - DNA, 3834 bp, Rattus norvegicus
  Genbank Accession No. NM_031668
atgaaatatgccctgaagcgcctaatcactgggcttggggtgggccgagaagctgctaggccctgctacagtctggcgctagcacagctgttgcagtcttttgaagacatccagttgtgtgacatcctgggacagatacaagaaaaatacaatctacaagcaatgaacaaggcaatgatgagacctactctctttgcaaacctgtttgcagtgcttgccctctttcagtcaggacgcctagtgaaggataaagaagccctgatgaagtgcgtgagattgctgaagatattgtcccatcactacaaccacttacaggggcagccagtaaaggctctggtggacatcctctccgaggtcccagagtccatgttccaggagatcctgccaaaggtcctcaagggggacatgaaagtgatcctcagctctcccaagtacttggagctcttcctcttggctcggcagagggtgccagcagagctcgagtcactggttggctcggttgatctgttctcagaagacaacattcccagtctggtgaatatactgaaggtggcggccaactctgtaaagaaggagcagaagctgcctgatgtggctctgaacctgctccgcctggcacttcaggagaacaaatttgaacggttctggaaggaggttttggaggaggggctgctgaagaagccatcctatacatccagctacatgtgtttccgcctactgggtgcatctctgccgcttctgtcagatgagcagttgcagttggtgatgcgaggagacttgatccgacattttggggagcacatggtcgtttctaagtcccaaaacccgctaaggttcattccagagataagtgcatatgtgggtaccttcctcgaggggtgccaggacgatcccaagcggcaattcactgtgatggtggccttcacggccatcaccaatcaaggtctccctgtcatgcctaccttctggcgtgtcacgcggttcttgaatactgaagccctgcagaactacgtgacctggctgcgggacatgttcctgcagcctgacctggactccttggttgacttcagcactgccaaccagaagagagttcaggacgcctccttgaatgtgcctgagcgaacagtattccggctccggaagtggatcatccaccgcctggtcagccttgtggatcatctgcacctggagaaggatgaagctgtggtcgagcaaatagccaggttttgcttgttccatgccttctttaagacaaagaaagctactccccagatcccagagacaaagcagcacttctccttccccttggaggacggcaaccgtggggtcattgtcagtgccttcttcagcctactgcagaccctcagtgtgaagttcagacagacaccagacctggctgaaaatgggaagccctggacttaccgcctggtgcagctggcagacatgctgttgaagcataaccgcaacgtagccaatgtgacacccttgacagcacagcagcgtcaggcctgggaccagatgatgagtacgctgaaggaactggaggcccagtcctcagagacccgggccattgccttccagcacctgctgcttctggtgggcctccacctcttcaagtcccctgcagaaagctgtgacgtcctaggagacattcagacttgcatcaagaaaagcatggagcagaatctgcgccgatcacgctctagagccaaagcctcccaggagccagtgtgggtggaggtgatggtggagatcttgctgtccttgctggctcaacccagtaacctgatgcgccaggtggtccggagtgtttttggtcatgtctgttcccacctgactccacgtgggctacagctaatcctggctgtgctcaaccctgagacaaatgaggatgaggaggacaacgtggtggtcactgacactgacgagaagcagctgaaacatggagaggacgcagactcagacagtgaggacagtaagaactcagagagtgacgtggatagtgaggatggggaagaaagtgaagaggaggaccgtgataaggatgtggacccaggcttccgacaacagctgatggaagtgttgcaagctgggaatgcactgggtggagaggaggaggaggaggaagagcttggggatgaggccatgatggccctggaccagaacctggccagcctatttgcagagcagaagatgcgtatccaggcccggcatgaggagaaaaacaagctgcagaaggagaagcagctccgacgagacttccagatcagggcactagacctgattgaggtgctggtgaccaagcagcctgagcaccccctgatcctggaacttcttgagccactgctaaacatcatccagcgcagcatgcgcagcagaggctccaccaagcaggagcaggacctcctgcacaagaccgcccgcatcttcatgcatcatctttgtcgtgcccgccactactgccacgaggtggagcctggcgcagaggctctgcatgcccaggtggagaggtttgtgcagcaggctggcaaccaggctgacgcctctgttgccctttactatttcaatgcctctctgtacctgctgcgagtcctcaagggcaacaccactaagaggtaccaagacggtcagaagttagagggagcagacatcaagtctgaacccaaggactcagaggtccagactaccagttgcttggacttggactttgtgacccgggtgtattcagcgtcattggaatctcttctgaccaagcgtaacagcccactcaccatccccatgttcctcgacctcttctcccgatatccagtgatctgtaagaacttgcttcccatcgtggtccagcatgtggctggctcatctcggccccgccatcaggcccaggcgtgcctgctgctccagaaggccctgtctgcacgggagctgagagtgtgttttgaggatcctgagtgggagcagctgattagccaggtcttgggaaagaccacccagaccctgcagactcttggggaagcacagagcaaaggggaacaccagagggagctatccatcttggagctgctgaacactgtcttcaggatagtcaatcacgagaagctgtctgtggacctcactgctttcttgggcatgcttcaaggcaagcagcagaagctgcagcaaaacctgcagcaagggaatcactcgtctggctccagtcgcctctacgatctctactggcaggccatgaacttgcttggagtgcagcgtccaaagtcagaaaagaagaatgtgaaggatattcctagtgacagccagagtcccattagcacaaagcggaagaaaaagggattcttgccagagaccaagaagcgaaagaaacttaaatctgagggtaccacatcagaaaagaaggctgcatcacagcaggatcgagtgacagagggtgccatgcctgctgccactggtaaagaccagccccccagcacaggcaagaaaagaaggaagagagtgaaggctaacaccccatcccaggtgaatggagtaactgtggccaagagtccggctcccaataaccccaccctgagtcccagcaccccccctgccaagaccccaaaagtgcagaagaaaaaagagaagctgtcacaggtgaatggatccactcctgtgtcccccgtagagcctgaaagcaaaaagcatcagaaggctctcagcacaaaggaggtcaaaagaaggtcctcccagtctgccctgccaaagaaaagagcaaggctgtctctggtgagcaggagccccagcctgttacagagtgggatcaggaaaaggagagtggccaggaggagagtccagacaccttga

SEQ ID NO: 2307 - DNA, 2996 bp, Rattus norvegicus
  Genbank Accession No. NM_031675
gtggggcgggctgaaagcagctgaagcggcggccgagtcgtaggctccgacataggggcggcagctgagcggtagcggaccggctggcgggctacgaaaagacgagggatggtggactatcacgccgcgaaccaggcgtaccagtacggcccaagcagcggcggcaatggacacgggcggcggcggaggcatgggcgactacatgcgcccaggaggagactgggaccgggacctgctgttggacccggcctgggagaagcagcagcgcaagaccttcacagcctggtgcaactcccatctgcggaaggctggcactcagatcgagaacatcgatgaggacttccgggatggcttaaacttcatgcttctgctggaggtcatttcaggggagcggttgcctaagccagagcgggggaagatgcgagtgcacaagatcaacaatgtaaacaaagccctggacttcatcgccagcaagggagtcaagctggtgtccattggggcagaagagatcgtggatggcaatgcaaagatgaccctgggaatgatctggaccatcatcctcaggttcgccatccaagacatctctgtggaagagacctctgccaaggaaggactcctcctctggtgccagagaaagacagccccgtataaaaacgtcaacgtccagaacttccatatcagctggaaggatggtctggccttcaacgcgctcatccaccggcacagacctgagctgattgagtatgacaaactgaggaaggatgatccagtcaccaacctaaacaatgcatttgaagtggctgagaaataccttgatatccccaagatgttggatgctgaagacatcgtgaacacaggccggcccgacgagaaggccataatgacatatgtgtccagcttttaccatgccttttcaggagcgcagaaggcgagactggtgccaaccggcatcttgaaggtgctggttgtgaaccaggaaaatgcgcacctgatggaagattacgagcggctggcagtggatcttctagagtggatccggcgcaccatcccctggctggaagaccgtgtgcctcagaagaccatccaggagatgcagcagaagctggaggacttccgagactataggcgtgtgcacaagccccccaaggtacaggagaagtgtcagctggagatcaacttcaacaccctgcagaccaagctgcgggtgagcaaccggcctgccttcatgccctccgagggcaggatggtctcggacatcaacaatgggtggcaacatctggagcaggctgagaagggctatgaagaatggctcttgaatgaaatcccgaggctggaacgactgatcaacctggcagagaaatcccggcagaaggcttccatccatgaaggctggaccgatgggaaggaggccattctgcagcaccgggactatgagacagccaccctgtcagacatcaaagctctgatcccaaaacatgaggcctttgagagtgacctggcggcgcaccaggaccgcgtggagcagatcgcggctattgcccaggagctcaacgaactggactactatgactcccacaacgtcaacacacggtgccagaagatctgtgaccagtgggataacctgggctctctgacccacagtcgcagggaagccttggagaaaacagagaaacagctggagaccatcgaccagctacacttggagtatgctaagcgggccgcgcccttcaacaactggatggagagtgccatggaggacctgcaggacatgttcatcgtccacaccatcgaggagatcgagggcctgatctcagcccacgaccagttcaagtccaccctgccagatgccgacagggagcgtgaggccatcctggccatccacaaagaggcccaaaggatcgctgagagcaatcacatcaagctgtcgggcagcaacccctacaccagcgttacaccccagatcatcaactccaaatgggagaaggtgcagcagctggtgccgaagcgggaccacgcactcctggaagagcagagcaagcagcaatccaatgagcaccttcgccgacagtttgccagccaagccaatatggtggggccctggatccagaccaagatggaggagattgggcgcatctccatcgagatgaacgggactctggaagaccagctgagtcacttgaagcagtacgagcgcagcattgtggactacaagcccaacctggacttgctggagcagcagcaccagctcatccaggaggccctcatcttcgacaacaagcacaccaactacacaatggagcacctccgtgtgggctgggagcagctgctcaccaccattgcccgcaccatcaacgaggtagagaatcagatcctcacccgagatgccaagggcatcagccaggagcaaatgcaggagttcagagcctccttcaaccactttgacaaggaccatggcggggcactggggcctgaggagttcaagggctgcctcatcagcctgggctacgacgtggagaatgaccggcagggtgatgctgagttcaaccggatcatgagtgtggtcgaccccaaccatagtggcctcgtgaccttccaagccttcattgacttcatgtcaaaggagaccacagacacagacaccgccgatcaggtcatcggctccttcaaggtcctggccggggacaagaacttcatcactgctgaggaacttcggagagagctgccccctgaccaggctgagtattgcatcgcccgcatggccgcctaccagggccctgatgctgctccaggcgcccttgactacaagtccttctctacagccctctatggggagagcgacctgtgagccctcagccaccctgaacagactcccttggcctccggagggctgaggagccctgccccaccctgactcagtatctatgctaagagctctttgtggtctctagggtcagaggcagggaggggctaggcaggcctcttttctcagtctggta

SEQ ID NO: 2308 - DNA, 1020 bp, Rattus norvegicus
  Genbank Accession No. NM_031676
gaattcgggggggctcctgtggctgctattgtgtggatgccgcgcgtgtcctctcttctcttccagagatggctaacaggggtccgagctacggcttaagccgagaggtgcaggagaagattgagcagaaatatgacgcggacctggagaacaagctggtggactggatcatcctgcagtgtgctgaggatatagagcacccgcccccgggcaggacccattttcagaaatggttgatggacgggacggtcctgtgcaagctgataaacagtttatatccaccaggacaagaacccatccccaagatctcagagtcaaagatggcttttaagcagatggagcaaatctctcagttcctgaaggctgccgaggtctatggcgtcaggaccactgacatttttcaaacagtggatctatgggaagggaaggacatggcagctgtgcagaggactctgatggctctgggaagcgttgcagttaccaaggatgatggctgctaccggggagagccgtcctggtttcacaggaaagcccagcagaatcggagaggattttcagaggagcaacttcgccagggacagaatgtcataggcctgcagatgggcagcaacaagggtgcctcccaggcaggcatgacggggtacgggatgccaggcagatcatgtaagatgttgtatagtgagtgccccctggtagagaggacggatgttccgcaccacagtctgtgacaaagaattaggtagtcaccttctcaccttctctttctcaaagccttctgtcccctgttcttgcaaagtgctgcacttctgctgagaatccacgctgcctactgctgcctactgctgccaccttctgttcctttagaactatgcaaagactgcccttcctctcgctgacctcctgtgccctaagatctcagtttgtttgattatttatttatttatttgccaaaaaaaatttctctccttgacttacagaacgtacctaataaacaaattagtctgtgaaaaaaaaaaaaaa

SEQ ID NO: 2309 - DNA, 840 bp, Rattus norvegicus
  Genbank Accession No. NM_031677
atgactgaacgctttgactgccaccactgcaatgagtctctctatggcaagaagtacattctaaaggaggagaacccgcactgtgtggcctgcttcgaggagctctatgccaacacctgtgaggagtgtggaacacccatcggctgtgactgcaaggacttgtcctacaaggatcgccactggcatgaaggctgcttccactgctcccggtgcgggagctcgctggtggacaagccctttgcggccaaggaggagcagctgctgtgcaccgactgctattccaacgagtactcgtccaagtgccaggagtgtaagaagaccatcatgccaggtacccgcaagatggaatacaagggcagcagctggcacgagacctgcttcacctgtcagcgctgccagcagcccatcggaaccaagagcttcatacctaaggagaatcagaacttctgcgtgccctgctatgagaagcagtatgccctgcagtgtgtgcagtgcaaaaagccaattaccacaggaggtgttacttaccgggatcagccctggcacagggagtgctttgtgtgcacagcctgcaagaagcagctatctgggcaacgcttcacagcccgggatgagtttccatactgcctgacctgcttctgtgacctgtatgctaagaagtgtgctgggtgcaccaaccccatcagtggtctgggtggcacaaagtacatctcttttgaggaacgccagtggcacaacgactgctttaactgtaagaagtgctccctgtccttggtggggcgaggcttcctcacagagagagacgacatcctctgtcctgactgtggaaaggacatctga

SEQ ID NO: 2310 - DNA, 5761 bp, Rattus norvegicus
  Genbank Accession No. NM_031678
ggctccgggcggctgcggcgcaggccgagcgcaccaagtgacgggtcgagcaaaggaccgacgcgcgggtggacgctgcgaagcgcctcattccagagcccgacatgaatggatatgtggacttttccccaagtcccaccagccccacccaagagccaggggagcctcaacccacccaggctgtgctccaggaagacgtggacatgagcagcggctccagcggaaatgaaaactgctccacggggcgggactctcagggcagtgactgtgacgacagtggaaaggagctgcggatgttagtggaatcgtccaacactcaccccagccctgacgataccttcagactcatgatgacagaggcggagcataacccctccacaagcggctgcagtagtgagcagtctgccaaagctgacgcacacaaagagctgataaggaccctgagggagctgaaggtccacctccctgcagacaagaaggccaaggggaaggccagcacgctggcaaccttgaagtacgctctgcggagcgtgaagcaggtgaaggctaatgaggagtactaccagctgctaatgtccagtgagagccagccctgcagcgtggatgtgccttcctacaccatggagcaggttgagggcattacctccgagtatattgtgaagaactcggacatgtttgctgtggctgtgtccctggtctctgggaagatcctgtacatctccaaccaagtcgcccccatctttcactgtaagaaggacgccttcagtgatgccaagtttgtggagttcctggctccccatgacgtcagtgtgttccacagctacaccaccccttacaagcttccgccctggagtgtgagcagtggcttagattctttcactcaggagtgcatggaggagaaatcttttttctgccgtgtcagtgttgggaaacaccacgagaatgagattcgctaccagcccttccgcatgacaccctacctggtcaaggtgcaagagcagaagggcgctgcgagccagctctgctgcctgctgctagcagagagggtacactcaggctatgaagctcctagaattcctcccgagaagagaattttcacaacaacccacacaccaaactgcctgttccaggatgtggacgaaagggcggtccccctcctgggctatctacctcaggatctgatcgagacccctgtgctcgtgcagctccaccccagcgaccggcccttgatgctcgccatccacaagaagatcctacaggccagtgggcagcctttcgattattctcccattcgattccgcacacgcaacggggagtacatcacactggacactagctggtccagcttcatcaacccgtggagcaggaagatatccttcatcatcgggaggcacaaagtcagggtaggccctttgaatgaggatgtgttcgcagcctccccttgcccagaggagaagactccgcaccccagcgttcaggagctcacagagcaaatccaccggctactgatgcaacctgtcccccacagcggctccagtggctatgggagcctgggcagtaacggatcccacgaacacctcatgagccagacatcatccagcgacagcaatggtcaagaggagtctcactggaggagatccggaatttttaaaaccagtggcaagagtcaaagcaaaagtcacttttctcctgagtctggaggacaaaaggaagcctctgttgcagaaatgcaaagtagtcctccagctcaggtgaggtctgtcaccaccatggaaagggacagctcgggggccagcctacccaaggctagctttccagaggaactaacctataagagccagcctccttgctcctaccagcagatcagctgcctggacagtgtcatcaggtacctggagagctgcaacgaggcagccaccctgaaaagaaagtgcgagttcccagccaacatcccatcccggaaggccacggtcagccctgggctgcactctggagaggcagcgcggtcctccaaggtgaccagccacacggaggtcagtgctcacttgagctccttggcgttgccgggcaaggccgagagtgtggtgtccctcaccagccagtgcagctacagcagcaccatcgtgcacgtgggcgacaaaaagccacagcctgaactagagacagtagaagatgtggccagtgggcctgagtcccaggatgatgcagctggtggcctcagccaagaaaaggggtctctgcagaagctaggcctcaccaaggaagttctggctgcacatacccagagagaggaacagggcttcctgcagaggttcagggaagtgagcaggctcggtgccctgcaggctcactgccagaactatctccaggagcggtcccgagccccagcaagtgatcgaggactaagaaatgcttctggaatagaatcatcttggaaaaaaactggaaagaacaggaaactgaagtccaagcgtgtcaagactcgagactcttctgagagcacagggtctgggggacccgtgtcccaccgacctcccctcgtgggcctgaatgccacagcctggtcgccctctgacacatcccagtctagctgtccctctgcaccattccctgctccagtgccagcttacccactacctgtgttcccggcacctggaatagtatccacaccagggacggtggtggcaccacctgcagccgcccacaccggcttcaccatgcctgttgtgcctatgggcacccagcctgaattcgcagtgcagcccctgccgttcgctgcccccttggctccggtcatggccttcatgctacccagctacccgtttccaccagcaaccccaaacctgcctcaggccttcttccccagccagcctcactttccggcccatcccacacttgcctctgaaataactcctgcctcccaggctgagttccctagtcggacctcgatgctcaggcagccatgtgcttgcccagtcacccccccggctggcacagtggccttgggcagagcctccccgccactcttccagtcccgaggcagcagtcccctacagcttaacctgcttcagctagaggaagcacctgaaagtagtactggagctgcagggaccttggggaccacggggacagcagcttctggtctggactgcacatctggcgcatctcgggaccggcagccaaaggcacctccaacatgcagtgagccctcagacacccagaacagtgatgccatctccacctccagtgacctgctcaacctcctcctgggcgaggacctctgctcagccaccggctcagcactgtcgagaagcggggcatctgccacctcagactcactgggctccagctccctgggctgtgacacatcccggagtggggcaggcagcagtgatacaagtcacaccagcaaatactttggaagcattgactcttcagagaataatcacaaagcaaaaatgatcacagacacggaggagagtgaacagttcattaagtacgtcttgcaggaccccatctggctgctgatggccaacacagacgacaatatcatgatgacataccagctgccctcccgggatctccaggcggtcttgaaagaggaccaggagaagctgaagctgctgcagaggtcccagccccacttcacggagggccagaggcgagagcttcgagaggttcatccgtgggtccacaccgggggtctgcctaccgccatcgacgtaacagggtgtgtttactgtgaaagtgaggagaaaggcaacctttgtctgccatatgaggaagacagtccttccctgggactctgtgatacctcagaagccaaagaggaggagagcggacagctggccaatcctaggaaggaggcccagacgtaaccccgtccccggctagaagtctacattagacggtgctcggaagaggtggaagagcttgtgtttctaacgaaatggacccataccttcactgcttcttttgttttagaaaaaaaaaacaaaacaccatagttttctgaaggtggaacagagctgtggggaggtttaggaggaaatacgtttttgtattaaaatagaaatatggaatttgggggatggggtgagattcgtcattggacttgaggagactgagaccatctgtgtgtcatctggaggtcagaagtccctgacctccatgagacctctttccagtgtaccagtgtcctcttacccctggggattgtcctgaaacatcaggatgtttcagatcaccaggatgtgacatataacggggaagccacatgaggctcagccaagggcctgctttctggaactttcccatggtgtggttgtatcagatcctatctcccaagcagagagaccacccctcctgacatcctctcagtgcgttcccttatgtggtttggagcatggtgtggcagcttttgcttcaggtcctgtggtggccagcattccagtcggacctggcttcagttcatcaacagagttgaaatgcctactctggactgatggagcttagtggtgtctgtgaccgatgccatcagactagcacccacactgtacgtttctgtgccgttcttggatcctttttagaccatcatggccagtgtgcagagagagctgtggcttcagccatgtcaccctgtctgtttggtggcctctgcaagccaagctttgttgctgctggggacgcggtcatatatttgttctttggttggactctcagatttcagcttccagcagaaagcagccactgaacatggggagagggcacccacactgtcaccctgagctcttcagtttgcagggagctcagcctcccactatatatatatatatattcctagctcctgtggctttggttctctgtcacatctgtctgtgctgctggtcctcagaccaccggaacccatggagagaaggggacctctctgcccagctctacaaaaccttatgctgcatcagacatccaaagattgttccgacatgcttcctggtgacccctggtggaatgagacatcaccagtgaggaactgttagacttaaaacatggacaaagtctggagcagaggaagcagactttcctgagtctaaagcggctactagaaaggtgttcctactatagctggttttcatgggaaagccatctgatgcctgaatatcacccctatttttcataaagataagaaatctatttttattattattattattaaagcaacaccacctttcacaatgatcaggtagtagccatgttttaaaggaaattcaatgttacagacagctgcctctgaccagtcagagcctaagagtagatagatggtggtctaagcctacgcttgttacttaaacacaaaactgccaaaaccttctctctactatcttgaatgtttaccatcagcattattttatgattatttaatatatattccttgattgttaactgctaagaagttgacttcctaggataattttgtgaatctgtttacaagatgccaagcatccagtcctgttttctttagaatgtgtgcttacacgggtgtcctgagactttctctatttgaaactgagccttctttgtaatgtaaataagctctcagagtttgtgcgatgatttgtgagccttgccggacaagcggtttgttcatgcgcaaaccaaacgtaccttcacccagtgcaatatatttgtgtgactgcttgtgtctttttatgacttttttgccttttagaaaattgttaaataaagcaagtatatttttattttc

SEQ ID NO: 2311 - DNA, 1766 bp, Rattus norvegicus
  Genbank Accession No. NM_031684
caccatgacaaccagtcaccagcctcaggacaggtataaggctgtctggctcatcttctttgtcctgggtctggggacactgctcccctggaatttttttataacagcaacccagtatttcacaagccgcctgaacacgtcccagaatatatccttggtcaccaaccaatcatgcgaaagcaccgaggccttggctgacccctcagtgtccttgccagcccggagttctctcagtgccatcttcaacaatgtcatgaccctgtgtgccatgttgcccttgctgatcttcacctgcctcaactctttcctgcatcagaaggtgtctcagtcccttcggatcttgggcagcctgctggctatcctgttggtgttcctcgtcactgccaccctggtgaaggtgcagatggatgccctgtccttcttcatcatcaccatgatcaagattgtgctcattaactcatttggtgccattttgcaagccagccttttcggtctggcaggcgtcctgccggccaactacacagcccccatcatgagtggccagggcctggctggcttcttcacctctgttgccatgatctgtgccgtcgccagtggctctaagctgtcagaaagtgcttttggttacttcatcacggcctgtgcagttgtcattctggccatactgtgttacctggccctgccttggatggaattctaccgacattacctgcagctcaaccttgcggggcctgcagagcaggagaccaagttggatctcatcagtgaaggagaggagccaagaggaggaagagaggaatctggggtgccaggccccaactctctacccgccaacagaaaccaatccatcaaagccatactgaagagtatctgggtcctggctctgtctgtctgtttcatcttcacagtcaccattgggttgttccctgctgtgactgctgaggtggaatccagcatcgcaggcacaagtccctggaaaaactgctacttcatccctgtggcctgcttcctgaatttcaatgtctttgactggctaggccggagcctcacagctatttgcatgtggcctggtcaggacagccgctggttgccggtcctggtcgcctgcagggttgtgtttatccccctgctgatgctctgcaatgtgaagcagcaccactacctgccctccctctttaagcatgatgtctggttcatcaccttcatggccgcctttgccttctccaatggctacctcgccagcctctgcatgtgcttcgggcccaagaaagtcaaaccggctgaggcagagactgccggaaacatcatgtccttctttctgtgtctgggcctggctctgggagctgtgttgtccttcttgttaagggcacttgtgtgagcgaccctgtgtggacagaggaactacactgcctgcttcctgctcacttccttcgctgttagggacgagcaggggtccagagggctgctcttctgctttcctccggtgctgggcccagatgtccaggaacaaaggagggagcctctgaggatggacttgggattgggggtcagagtggtagggggacaatggtctctgacggacagctctgactgatccctgcctaagccaagcacaagagactccacaaggatggggtggagacagatggctgactgtgtatcatgatctgatgtcccttgcccttctttcttctgtgcctgttccaggtccccgatccttgtcattttactgccttttttatactgacagaaaccaggtgccttca

SEQ ID NO: 2312 - DNA, 747 bp, Rattus norvegicus
  Genbank Accession No. NM_031690
ctggttctcctccagtttgaggcggaagtgtccccggagacatggcagagcagcacggagcacctgagcaggctgcagctaacaagagccacggaggccttgggggcagctacaaggtgacggtgtacgagttagagaacttccagggcaagcgatgcgagctctcggctgagtgtcccaacctcactgaaagcctgctgcagaaggtgggctctatccaagtggaatctggaccgtggctggcgttcgagcgcagggcttttcgtggggagcagtttgtcctggagaagggggactaccccgcgtgggatgcctggtccagcagccggcgtagtgacattctcctgtccctccggcctttgcacattgatggcccagaccacaagctgcacctctttgagaacccagccttcagtgggcgcaagatggagatcgtagatgatgatgtgcccagcctgtgggcccatggcttccaggaccgtgtggccagcatccgagtcatcaacgggacgtgggtgggctacgagttccccggctaccgcgggcgccagtacgtgttcgagcggggcgagttccgccattggaacgagtgggacgccaaccagccgcagctgcagtcggtgcgccgcatccgcgaccagaagtggcacaagcgcggctgcttcctgagcagctgaggacccaggtcccaggagccaacgtctgtgtcccctcctgtacctgctcaataaagcccatcagccacgc

SEQ ID NO: 2313 - DNA, 2725 bp, Rattus norvegicus
  Genbank Accession No. NM_031695
aagcaggctgcgccgtggctggccccacagtgggctgggaaaggattggccacggtgacagccgccccgtggccagcacaatgaagtgctcccttcgagtgtggttcctctctatggccttcctgctggtgttcattatgtctctgctcttcacgtactcacaccacagcatggctaccttgccctacctggactcggggactctgggcggaacacaccgagtgaagctggtaccgggctatactgggcaacagcgccttgtcaaggaggggctttcggggaaaagttgtacctgcagtcgctgcatgggtgatgccggcacctctgagtggtttgacagccactttgacagtaacatctcacctgtctggacgagagataacatgaacctcaccccggatgtccagcggtggtggatgatgctgcaaccccaattcaagtcacacaacaccaatgaagtgctggagaagctcttccagatcgtgcccggtgagaacccctaccgcttccgggacccccagcagtgccggcgctgtgctgtggtcgggaactcaggcaaccttcggggctctggctatgggcaagaagtggacagccacaactttatcatgaggatgaatcaggcaccgactgtaggctttgagaaggatgttggcagccgaacaactcaccatttcatgtacccggagagtgccaagaacctgcctgccaacgtgagctttgtgctggtgcccttcaaggccctggacctgatgtggattgccagcgccctctccacaggacagatccgattcacctatgctccagtgaagtccttccttcgagtggacaaagagaaggtccagatttacaacccagccttcttcaagtacatccatgacaggtggaccgagcaccatggccgctacccctccacaggaatgctggtgctcttctttgcactacacgtgtgtgatgaggtgaacgtgtatgggttcggggccgacagccgtggcaactggcaccactactgggagaacaaccggtacgcgggcgagttccggaagacaggcgtgcatgatgccgacttcgaagcccacatcattgacattctggccaaggccagcaagattgaagtctaccgagggaactgagcagcctcaggcgccttcagaaccagtcacttcagggtctggcaagcgccggttgccgcccaccaatcagactgcgccgtccccagcaaccaatcagtgctgcagttgggaggagcttctttcttagccaatcacacaactcaaggagaacttccggcgccgccgtctccaccaatcatggccttgggaggcggcgggcctggaccccctcccccaacccccaacccccaaccccgctttggatgagaatttttctgctttttaagaggccggtctgggtctgggagggagcaccttgaactgctcatttccagcttagtcccgatgggtgagtgaagcccgccaaagaaatgtggtcccggcgagatactttccagggcattctgtggctcaccagctagtagggggttgtattcactccctagttgggttaactcattaagaatgggaaattattatgtggacactgaagggaagtgttttctggggcctgaggcattcactgaagccctttctcccaaatgaacctcaactttgacctaggtcaagtcatgcaaatagcttccagttgtaacccgattcttgactcaccagccctttaggagctggaaagtaggttagaacaggcgagtaagcatggtaaaggggcggacaggaggagccatgcatggcagataccaatctgctcctccccagcaaagctccgagccatctgcaaggcctgcaaacaactgtcaagcgatcttggttggatagccatccctggcagctggagggtaactaaagtatgaatccaaagcaaatccaacacccaagcaagaggctgcctgctcctctttggggtgacaatgaaagaaaaagatacatgcacagggcactcctttccagcctactgtccaaccctgctgctctcgccttagggctaaagacttgggccgcgtgtgtgagagcacaagcagcggagtcccggtggtctcattttgtctccaaatcaacaggtgagctggagaggagacccaggacctaaggacagacgctgagaaggtggtggggaacaggagtgagggcacacgtgagagaagcaccttgcatgtgacccggtggagcttcctacccgttcctgacactaatgaggccctagggaggtcgacattaacaagcagcttcctggttgggggacagtcacacgtaaggagtgtgttaaagtttggtatgaggcaagtacccctaaaaactaatatatgaagaactttgcttgaatttgttccttccaagtttcaaaagcaggggtagagaaaaagggagtataccgagaagggctgtagcggaacctctcagggctctaatcatcgtgcagtcactgtaccagtggccgttcttgcctgtctccgctctcccaagaagctgctgtgatgagaagtgggaaagtactgcgattacgacaaacagtattgagaagaagaatttatttttcctccttttgttttgcttaaaccatgagtcaccattctagaaaaggtaggtcccagcacccacatcctttttcttctacagttatttaaacattcaatttttccctctgtttcttttcc

SEQ ID NO: 2314 - DNA, 2234 bp, Rattus norvegicus
  Genbank Accession No. NM_031698
ctcggaggaatggcgccgccgggttcaagtgctgtcttcctgttggccctgacaatcacagccagcacccaggctctgacccccacccactacctcaccaagcatgatgtggaaagactgaaagcctcactggatcgccctttcacgagcttggagtctgccttctactccattgtgggactcaacagccttggggcacaggtgccagatgtcaagaaagcgtgtgccttcatcaagtcaaaccttgatcccagcaacgtggattctctcttctatgctgcccaatccagccaagtcctctcaggttgtgagatatctgtttcgaatgagaccagagatctgcttctggcagcagtcagcgaggactcctccgttgcccaaatctaccatgcagttgccgccctcagtggctttggtcttcccttggcatcccatgaagcccttggtgcccttaccgctcgcctcagcaaggaggagactgtgctggcaaccgtccaggctctgcacacagcatcccacctatcccagcaggctgacctgaggaacattgtagaagagatcgaggaccttgttgctcgcctggacgaactagggggtgtgtatctccagtttgaggaaggcctggaacttacagcattgtttgttgctgccacctacaagctcatggaccatgtggggactgaaccgtccatcaaggaggatcaggtcatccagctcatgaacacaatcttcagcaagaagaactttgagtccctctcagaagccttcagtgtggcctctgctgctgctgcattgtcccagaatcgctatcacgtaccagtggtggttgttcctgagggctctgcttctgacactcaagaacaggctatcctgcggttgcaagtcagcagtgttttgtctcacgctctggctcaagccgcagttaagctggaacatgctaagtccgtggcttccagagctactgtcctgcagaagatgcccttttcacttgtaggggatgtttttgagctaaacttcaagaatgttaaacttcccagtggctactatgacttctctgtcagagttgaaggtgacaaccgttacattgcaaacactgtagagcttagagtcaagatctccactgaagttggcatcaccaatgctgatctttccactgtggacaaggatcagagcatcccacccaaaactacccgggtgacctacccagccaaagccaagggcacattcatcgcagacagccatcagaacttcgccctgtttttccagctggtagatgtgaacaccggtgcggagctcacccctcaccagacatttgttcgacttcataaccagaagactggccaggaagtggtgtttgttgctgagccggataacaagaatgtgcataagtttgaactggacacctctgaaaggaagattgagttcgactctgcctctggcacttacacactctacctaatcatcggggacgccactttgaagaaccccatcctctggaacgtggctgatgtggttatcaagttccctgaagaagaagctccctccactgtgctgtcccagaacctttttaccccaaaacaggaaattcagcacctgttccgagagcctgagaagaggccccccactgtggtgtccaatacattcacggccctcatcctctcgcccttgctcctgctctttgcactgtggatccggattggagccaatgtctccaacttcacctttgctcctaccacgattatctttcacctgggacatgctgcaatgctggggctcatgtatgtctactggactcagctcaacatgttccagaccctgaagtacctggccgtcctgggcactgtgacatttctggctggcaaccgaatgctggcccagcaggcagttaagagaacagcacattagttccagaagaagtttgaagaccctgaactcggaaatgaccgtttaacaaagagtggagacagttcagagtgtggaaagaatcgggggacagaataggagaagaggaaatacctgttatttaaagagagaaaagtcgagctatgcttacacgtttacttgtttctcactttttgcttcactgaacagatatgtttggacccagattgtctgtccctttgttgtgatgcctggccagattctgtgaatatcccaggttacccagaggttgtatttgaaaagttgaaatctgtaattcatcagctttggaataaagagaatggtggactccc

SEQ ID NO: 2315 - DNA, 696 bp, Rattus norvegicus
  Genbank Accession No. NM_031706
ctctttccagccagcgccgagcgatgggcatctctcgggacaactggcacaagcgccgcaagaccgggggtaagagaaaaccctaccacaagaagcggaagtatgagctgggacggccggccgccaacactaagattggccctcgccgcatacatacagtccgagttcgaggaggcaataagaagtatcgtgctctgagattggatgtggggaacttttcctggggctcagagtgttgtactcgcaaaacaaggatcattgatgttgtctacaatgcatccaataacgagcttgtccgcaccaagaccctggtgaagaactgcattgtgcttattgacagcacaccgtaccgacagtggtacgagtcccactatgcactgcccctgggccgcaagaagggggccaagctgactcctgaggaggaagagattttaaacaaaaaacgatcaaagaaaattcagaagaaatatgatgaaaggaaaaagaatgccaaaatcagcagtcttctggaggagcagttccagcagggcaagcttctcgcctgtattgcctcaagaccaggccagtgtggcagagcagatggctatgtgctcgaaggcaaggagctggagttctatctgcggaagatcaaagcccggaaaggcaaataaactgtcatagctcgtgtaataaaggtgtttgctgttctgtatatgt

SEQ ID NO: 2316 - DNA, 4050 bp, Rattus norvegicus
  Genbank Accession No. NM_031707
ctgaagctggcttttgcgtttttctacacgtacactaattttatggaatagttaaagtgctatattctccgcgcaaccttttcaaattccaaatgtttgaacgttttggtgtcagcgcgagtgaaatcattttaccgacaagaactaactgaattgtctgcctcgttgagttgcctccggaaaagatctcgggggtggaaaagcaactgcaaaataacagacggagaaaattccttggaagttatttctgtagcataagagcagaaacttaagagcaagttttcattgggcaaaatgggggaacaacctatcttcagcactcgagctcatgtcttccagatcgacccaaacacaaagaagaactgggtacccaccagcaagcatgcagttactgtgtcttatttctatgacagcacaaggaatgtgtataggataatcagtctagacggctcaaaggcaataataaatagcaccatcactccaaacatgacatttactaaaacatctcaaaagtttggccaatgggctgatagccgggcaaacactgtttatggactgggattctcctctgagcatcatctctcaaaatttgcagaaaagtttcaggaatttaaagaagctgctcggctggcaaaggagaagtcgcaggagaagatggaactgaccagtaccccttcacaggaatcagcaggaggagatcttcagtctcctttaacaccagaaagtatcaatgggacagatgatgagagaacacccgatgtgacacagaactcagagccaagggctgagccagctcagaatgcattgccattttcacatagtgccggggatcgaacccagggcctctctcatgctagttcagccatcagcaaacactgggaggctgaactagccacgctcaaggggaacaatgccaagctcaccgcagcgctgctggagtccactgccaacgtgaagcagtggaagcaacagctggctgcctaccaggaggaggcagagcggctgcacaagcgggtcacggagctggaatgtgttagtagtcaagcaaacgcggtgcacagccacaagacagagctgagtcagacagtgcaggagctggaagagaccctaaaagtaaaggaagaggaaatagaaagattaaaacaagaaattgataacgccagagaacttcaagaacagagggactctttgactcagaaactacaggaagttgagattcgaaataaagacctggaggggcagctgtcggagctggagcagcgcctggagaagagccagagcgagcaggacgctttccgcagtaacctgaagactctcctagagattctggacgggaaaatatttgaactaacagaattgcgggataatttggccaagctactagaatgcagctaaagaaagtgaaatttcagtgccaatagatgaagagatactgtctgtcttcgtaggactgtttgggctctgtaccaagattgcacaaaattttttgaatatcattcctccagaaggagggtgttttgaaaattggaattgtatatttcagtataaattttagaatttagcttatagctagttgggggaaaaaagacatgaaaaacttgaaccacaaattacctccatgtacattggccatagttaaccagaaagttataagtagacacttaatgcaatcttttcccctgatagtagccaatgggagaattaacaatgtctgggtcccttctcctttttctgttcaacacagtgaagattatctgctttttaaatttatttacgatatctacagctgtgttttgtgtaaaaacttagtaatggaagccctgtctttgttgttatctgaataatttctcaggatatttttttgctgctgagaaagggccattaccaattaatccttgccaggagttggggagctatgtctctaattggaatcactataactgggtgtctggagttcttcccttttcgtactgagagtgttctcactctagtgactcctctggtacactccgtgttctccaatcttgtctgttgtactttacttttccatattgactccatgtatttatgagaagatattatctcccattttattatacattttgaagccaactaaacaaaggcagctgagtccttcagatatttttctttttaaatttatagtaaatttgacacagaactgaaattcagcagtccgtctttgacggtttagtctagcaatgttaaggatatttagagaaaatatgcagttacgtttatttatatatttggcaagaaattttttctggatgatcaatgcttttcaatttatgataaataatggttagggggcgctgtttattatagataattttaaggtatatagctgttttcaaggaggtccacttccgtctagcagccaagcagaggactgtatctaaatcgtgatcgtggcagatgggtcttcatagaaaccatgtctttattcaaacttcatagggcaatattttgaactgttacctaggcatttcaaaacaggaaataccgtcaacagactcttctccaagagcaggttttactgttgttttgatgtaattttaagacatttagcaaacatgcatttctttatatgatacatttctttcacaaaacaatttaaaagtaagccacgtgctgtctgctctgcccgggtaggaattgcatcagaatacatatatcttgctgtacaatgcctgtgatattgaagagggttcttttcatgtatgcttgagtatctaactctggagtcaatgaatgcactgacttttttttttgttcgtaccccaaatgattgaattgttaagtacaaattaagcagattaactcattttttcactcataaacagattcttagtactagttttgttttatatttatgtgtatgtatgtaaatacatacatattaatttatattagagtgaaaaataaattgtttgtttctaacattagtttctacagtaaggtgtctctgaaacatgtgtgtcagacacttagccaccatgcattctatgtgctaccccatcatgccagtcacctccatcgacgttagggtattttccttacctgtctattataaagagaataacttaggtacacatgctcagagccgagatatttctctgataaatcaggtaataaaatctatttgatgggtagaattttgaaaacagacatgattttatctatgagtttctgaatatcaaagaacaccaggttttcatttaaatagaggtctaacactagggatcagggaatttagttatgaagagtttaaaaaaaaaatctaaaaaagtaaaaaaaaaacagtataagctgttgataaggtaagcaaattattttaatgatgtaataaaatatttttaaattttggcatagtgatcatttaatgggaaaatactcaccaaaatgtctccacttgaattgtactgataatgtgaggcatatgtgtaactcaatatatacatatacctatatgtatatacagaaattatttttaatattttcctactgctgtgaaatttaaaattggaaaattttgtgagtgttttccatgtccaatagagcctaactgtttcttttttagtaacttaacaatctcttgagggctgcacctataaagtcccagcttgtcagtagacatgtacagtgtttgggataaggtggacacagtgcacatatgagtaagaccttcctgactattttaaacatcactcacatgaggagagcctctatgctataggttgtgtgcctactgtagcttttccatcgctgtattatatagacatttgcatattaaaatttgattttcccagagataaatattatatagtgtatctatatttagatcaaactgtggtaacatgttgatgagatcatagcgttggggaatgtagcctgaacgtgtggactcgcagagaccccgagggagagcaggggtcaatcccatctgtgtataagttattataactatgaaatcttgtacaaaagcaaaaactggaaaaaaaaacaaaaatacagtttttattttgaaat

SEQ ID NO: 2317 - DNA, 1444 bp, Rattus norvegicus
  Genbank Accession No. NM_031708
ccggcaggcgccgaggaggaagagcgagcccggacggtgcccctaggccgagtgtgagcgcggccaggatgacgacttcaggcgctctgttcccgagcctggttcccggctctcggggatcctctatcaagtatttggtggagttccgggcaggaaaaatgtcattaaaaggaactacggtcaccccagataaacggaaagggctcgtgtacatccagcagaccgacgattcccttattcacttctgttggaaagacaggacctctgggaccgtggaggatgacttgattatctttcctgatgactgtgagttcaagcgggtgcctcagtgccccagtgggagggtctacgtgctcaagtttaaggcagggtccaagcggctgttcttctggatgcaggagcccaagactgaccaagatgaggagcattgccggaaagtgaacgagtgtctgaacaacccccccatgcctgggacactgggagcgagtgggagtagtggccacgagctttcagcactgggcggtgagggtggcctgcagagtctgttggggaacatgagtcacagccagcttatgcagctcatcggaccagccggcctcggaggactgggtgggcttggggccctcactgggccaggcctggccagcttgctggggagcagtgggcctccagccagcagctcctcatccagctcccggagccagtcggcagccgtcaccccgtcctctaccacctcttccgctcgcgccaccccagccccttctgccccagcagctgcctcggcgaccagcccgagtcccgcacccagctcgggtaatggaaccagcacagcagccagcccgacccagcccatccagctgagcgacctccagagcattctggccactatgaacgtcccagcagggccaggaggcagccagcaggtggatctggcgagtgtgctgacaccagagatcatggctcccatccttgccaacgcagacgttcaggagcgcctgctgccctacctgccctctggggagtctctgccccagactgcagaggagatccagaacacattaacctcgccccagttccagcaggccctgggtatgttcagtgcggccttggcctcaggacagcttggccctctcatgtgccagtttggccttcctgcagaggctgtcgaggccgccaacaaaggtgatgtggaagcatttgccaaagccatgcagaataatgccaaatcagaccccaaggagggcgacacaaaagacaagaaagacgaagaggaagatatgagtctagattaaattattcgctgtccttccccagttggaattcgtagttgtgtgattccgtagtggtgattgtgatttgttcctggccgcctccccgccccaccccaccctacccacctcactaataaagtcctctcttgtacccgtcaaaaaaaaaaaaaaaa

SEQ ID NO: 2318 - DNA, 499 bp, Rattus norvegicus
  Genbank Accession No. NM_031709
tgttttcccctgccgccgccaagttccgcggagaagctccggggtgcgttcaagattcggcgtcacccgtaatccaccgccatggccgaggaaggcatagctgctggaggtgtaatggacgtcaacactgctctacaagaggtgctgaagaccgccctcatccacgatggcctagcacgtggcatacgcgaagctgccaaagccttagacaagcgccaagcccatctctgcgtgcttgcatccaactgtgatgagcccatgtatgtcaagctggtggaggcgctcttggccgagcaccagatcaacctgataaaggttgatgacaacaagaaactaggggaatgggtaggcctctgtaaaatcgatcgagaggggaagccacggaaagtggttggttgcagttgcgttgtagttaaggactatggcaaagaatctcaggccaaggatgtcatcgaggagtacttcaaatgctagaaatgaataaataaaattttggctc

SEQ ID NO: 2319 - DNA, 984 bp, Rattus norvegicus
  Genbank Accession No. NM_031710
  misc_feature (1)..(984): n = a or c or g or t
atggagcgaaggaaccacagtgggagagtgagtgaatttgtgttgctgggtttcccagctcctgccccactgcgagtactactatttttcctttctcttctggnctatgtgttggtgttgactgaaaacatgctcatcattatagcaattaggaaccacccaaccctccacaaacccatgtattttttcttggctaatatgtcatttctggagatttggtatgtcactgttacgattcctaagatgctcgctggcttcattggttccaaggagaaccatggacagctgatctcctttgaggcatgcatgacacaactctactttttcctgggcttgggttgcacagagtgtgtccttcttgctgtgatggcctatgaccgctatgtggctatctgtcatccactccactaccccgtcattgtcagtagccggctatgtgtgcagatggcagctggatcctgggctggaggttttggtatctccatggttaaagttttccttatttctcgcctgtcttactgtggccccaacaccatcaaccactttttctgtgatgtgtctccattgctcaacctgtcatgcactgacatgtccacagcagagcttacagactttgtcctggccatttttattctgctgggaccgctctctgtcactggggcatcctacatggccatcacaggtgctgtgatgcgcatcccctcagctgctggccgccataaagccttttcaacctgtgcctcccacctcactgttgtgatcatcttctatgcagccagtattttcatctatgccaggcctaaggcactctcagcttttgacaccaacaagctggtctctgtactctacgctgtcattgtaccgttgttcaatcccatcatctactgcttgcgcaaccaagatgtcaaaagagcgctacgtcgcacgctgcacctggcccaggaccaggaggccaataccaacaaaggcagcaaaattggttag

SEQ ID NO: 2320 - DNA, 2757 bp, Rattus norvegicus
  Genbank Accession No. NM_031715
gccagcgaggagagctaaaactacaagagtggatcatgacccatgaagagcatcatgaagccaaaaccctggggatcggcaaggccatcgccgtgttgacctctggtggagatgcccaaggtatgaatgctacggtcagggctgtggtacgagttggcatcttcaccgggctccgcgtcttctttgtccatgagggttaccaaggcctggtggatggtggagagcacatcagggaggccacctgggagagcgtgtccatgatgctccagctgggaggcacggtgattggaagtgcccgatgcaaggacttccgggagcgagaaggacgactccgagctgcccacaacctggtgaagcgggggatcaccaatctgtgtgtcatcggaggcgatggcagcctcactggggctgacacttttcgttcagagtggagtgacttattgaatgacctccagaaagatgggaagatcacagccgaggagcgtacaaagtccagctacctgaacatcgttttcctggttggctcaatcgacaatgacttctgtggcactgatatgaccattggtactgactctgccctgcaccgcattgtagagatcgtggacgccatcaccaccaccgctcagagccaccagaggacatttgtgttagaagtgatgggccgccactgtggatacctggcccttgtcacctctctgtcgtgtggggccgactgggttttcattcccgagtgtccgccagatgacgactgggaagaacacctttgtcgccgtctcagtgagacaagaacccgtggttctcgtctcaacatcatcattgttgctgagggtgcaatcgacaaaaacgggaagccaatcacctcagaagacatcaagaacctggtggtaaagcgtcttggatatgataccagggtcactgttctgggacatgtacagaggggtgggacaccatcagcctttgaccggatcctgggcagcaggatgggtgtggaagcagtgatggcacttttggaggggaccccagacaccccagcctgtgtggtgagcctctctggtaatacggctgtgcgcctgcccctcatggagtgtgtccaggtgaccaaagacgtgaccaaggctatggatgagaagagatttgatgaagccattaagctgagaggccggagcttcatgaacaactgggaggtatacaagcttctagctcatgtcagacccccagtctctaagggcgggttgcacacggtggctgtgatgaacgtgggggccccagctgctggaatgaatgctgcagttcgctctactgtgaggattggccttatccaaggcaaccgagtgctggtcgtgcatgatggctttgagggtctggccaaaggtcagattgaggaagctggctggagctatgttggaggctggactggtcaaggtggttccaaacttggtactaaaaggactctacccaagaagaacctggaacagatcagtgccaacataaccaagtataacatccagggcctggttatcattgggggctttgaggcttacacagggggcttggagctgatggagggcaggaagcagtttgatgagctctgcatcccatttgtggtcattcccgccacggtttccaataatgtcccagggtcagacttcagcatcggggctgacacagcactgaacaccatctgcacgacctgtgaccgaatcaagcagtctgcagcaggcaccaagcggcgagtgtttatcatcgagacgatgggtggttactgtggctatctggccaccatggcaggactggcggctggggctgatgctgcctacatttttgaggagcccttcaccatccgagatctccaggttaatgttgaacatctggtgcagaagatgaaaacaactgtgaagagaggcctggtgctgaggaatgagaagtgcaacgagaactacactactgatttcattttcaacctgtactctgaggaggggaagggcatcttcgacagcaggaagaacgtgcttggccacatgcagcagggtggaaacccaactccctttgacaggaattttgccaccaagatgggtgctaaggctacgaattggatgtctgggaaaatcaaagagagttaccgtaatggacggatctttgccaacactcccgactcaggttgtgttctggggatgcgtaagagggccctggtctttcagccagtgactgagctgaaggaccagacagattttgagcaccgaatccccaaagaacagtggtggctgaagctgaggccaatcctcaaaatcctggccaagtacgagattgatctggacacctctgaccacgcccacctggagcacatttccaggaagcggtctggagaagctgctgtctagaccactttggagtgaggggaaaatcacctgatcatggtcagctcacaccctggtagacctcagcccatggcttctcagtgttgtagcccagcccctacccttctaggtttccctgtactctgtacctgcaaccaggatcactgtggccaggtgttgggggaggggtggtgagtgcctctcctaggtagctgtccttccttgcaccctggcttcatctgtcacacaggctggatgtctctagtgctactgctagatttcagcttctcaagagtaaaagtgagctttatttatttctttgtgataacaaagagtcctaggtcctttccttgtaccacagtgaagtgtaactacactaataaaagccagctggccactgtga

SEQ ID NO: 2321 - DNA, 1399 bp, Rattus norvegicus
  Genbank Accession No. NM_031719
ctgctttcttggttcctgtggagcaatgctttcgcccgcaatgagcttcctcaaaagcttcccgccccctgggtccgcagatggactccggctgcagcagccagacaccgaagctgtgctgaacgggaaggggctcggcaccggcacgctttacattgcggagagccgcctgtcttggctagatggttctggattaggattctcactggagtaccccaccattagtttacatgcggtatccagggacccaaatgcttatcctcaagaacatctgtatgtcatggtgaatgccagatttggagaagaatcaaaagaacctttctctgatgaagatgaggacgacaatgatgatgttgaacccatttctgagtttagatttgtgcccagtgataagtcagcattggaggcgatgttcacagcaatgtgtgagtgccaggccctgcatccagaccctgaggatgaagactcggatgactatgatggagaagagtatgatgtggaagcacatgagcaaggacagggggacatccctacattttacacctatgaagaaggactatcccatttaacagcagaagggcaagccacgctggagagattagaaggaatgctttctcagtctgtgagcagccagtataatatggcaggcgtccgaacagaagattcagtaagaacttacgaagatggcatggaggtagagaccacaccaactgttgccggacagttcgaggatgcagacgttgaccactgaggatgactcgtgtgacttacaattctgctcataactataggcaagaacttgatgcctcttcactccagaatggagctggtgaaaggctttttttcttctccaaaactcatttctcaagacaaactataatgagacagcaagctgtcaccagcagaaaagactttgacctctattaacaaaggtgaattaactgaacgggtttttgtagtttctcatttacccctaagcttcctgtgtctagttatcttctgagagcctctaattcctgctttgctgtgtgcaatctgtcagctacgaggctgtgtgtcgtgtgcacagtctcacgctggcaaaagtgaggtgggagcttagatgtctctgggacttaggaggactctctgatccctgagataaaaagcaaaggcctctgagggcacagctttagcattctccacggacgcatgggccctctactggggctcaaccacatctcgtcatgacaaatgcttgtgtgctacttctgttcctccgcatttaccatcagctctgttacattctcctagcttaggtccttgactgtcacagagtaaatcatctgaaatgaagtctgcaaagtactctcaatgatattttgtctttgtaatagttaaataaatctgggttttctat

SEQ ID NO: 2322 - DNA, 2610 bp, Rattus norvegicus
  Genbank Accession No. NM_031735
gtgggcttcggccggctgctcccaggctcctttccttcctacggccttcacggtccattcggtccctctttctgccaccggccgccatggagcagccgccggcgcccaagagtaagctaaaaaagctgagtgaagacagtttgactaagcagcctgaagaggtctttgatgttttggagaagcttggagaagggtcttatggaagtgtttttaaagcaatacataaggaatctggtcaagttgttgcaattaagcaagtacctgttgagtcagatgttcaggaaataatcaaagaaatttccataatgcaacaatgtgacagcccttacgtggtgaagtactatggcagttactttaagaacacagacctctggattgttatggagtactgtggggccgggtccgtttcagacataattagattacgaaacaagacattaacggaagatgaaattgcaactattctaaaatccacgttgaaaggattagaatatttgcattttatgaggaaaatacacagagatataaaagctgggaatattctcctcaatacagaaggacatgcaaagcttgcagattttggagtggctggccagttaacagacacgatggcaaaacgcaatactgtaataggaaccccgttttggatggctcccgaggtaattcaagaaataggttacaactgtgtggctgacatctggtcccttggcattacgtctatagaaatggcagaaggaaaacctccttatgctgatatacatccaatgagggctatttttatgattcctacaaacccaccaccaacattcaggaaacctgagctctggtctgacgacttcacggattttgtgaagaagtgcttggtgaagagtcctgagcagagggccactgccacccagctgttacagcatcctttcatcaagaatgcgaagcccgtgtcgatattgagagagctgatcacggaaggcatggaaatcaaggccaagcggcatgaggagcagcagcgagagctggaggacgaggaggaaaactcggatgaagatgagctggattcgcacactatggtgaagactagttcagaaggtgtgggcacaatgcgggccaccagcacgatgagtgaaggggcccagaccatgattgaacacaacagcaccatgctagagtcggacctggggaccatggtgataaacagtgaggatgaagaggaggaagacggaaccatgaaaagaaatgcaacgtcaccccaagtacaaagaccttctttcatggactactttgataagcaggacttcaagaacaagagtcatgaaaattgtgatcagagcatgcgtgagccatgccctatgtcaaacaatgtttttcctgacaactggagagttcctcaagatggagactttgattttttaaaaaatctaagtttagaagaactacagatgcggctaaaagcactggaccccatgatggaacgagaaatagaagaactgcatcaaagatacagtgcgaaaagacagcccatcctggatgccatggatgccaaaaagaggaggcagcagaatttctgaccagatcccttctgtctctgtgtgaccagagaccaaggaacacaggaattgaaggaactgtaatactttttaatccctaaaatgtatactctacaatttttttagaagtcaaaaatgatggtacacacctagataaatttcccaaaagcaaactttgcagttgtgtcctcgatgacgtcggtttaaacggatgagaacaatacacatgcgcacctctctctctgccagccgttacctgcaacagaaccaacctgcgactgaagccgcctgtggaggcggagtccagcgccattgctttgggctcacagcactgcagggcttgtgttgccctgatcttccttcctgtggagaagcctatttattgaccccctaggtagacttatttatttatgcagctttttttttttggaggggggggttctaaaaaaagatcaggatagttttggtgaatgtccagacacatcacagattgtaacactcaaccaaattgtacactaagcagggagctatgggtgtattcctttatctccagtaaaaataaagccataatgtccacatggaccagacaattttataagtgttaattcttgattttgatattggtacaaataaaactatatatacataggtcaaaaagagttatacagtgtaaaaccaaagaaatcaatgaatttttgcaccaaaaaagtgtgggaaatatttttaaagacatgaaacccaagaagacagtgcagtcgttaatgtttcctttattggtctgtagtaacttcaagttcattctatgggacatgcttctgtcacagggcttttgttgacttcattctactcctgggaattggtaagcatcatgtatctgacaataaagcagtaatatgtttatactaaaactgtgtgtccttagggcctaaaaaatgaaagcattagaaaaaggctcctttctgagaagcaattagcatttgtgtaattgacctgggaccagtcatttcctgcactacacagggccattttgatatcgtgttcttttatgtgttaattactatgtgtgcag

SEQ ID NO: 2323 - DNA, 2866 bp, Rattus norvegicus
  Genbank Accession No. NM_031753
gtggaggaaagttgcgtgtggcacagacccgacggcgcagcgccacagcgaccgggggatcgtgtgtcttggaaaaaaaagtcgctgtccccctaagcgagacccacaagcgagcgggccccgtgggcccggggacgacgccccctctgcggcgtggactttgtcggtggccttctaggaggaggaatatggcatctaaagggtccccttcttgccgtctggttttctgcctcttgatctccgccgcggtcctcagaccaggcctcggatggtacactgtcaactcagcatacggagataccattgtcatgccttgcagactggatgtacctcagaacctcatgtttggcaaatggaaatatgaaaagcctgatgggtccccagtatttattgcattcagatcttctacaaagaaaagtgtgcagtatgatgatgtaccagagtacaaggacagactgagcctctcagaaaactacactctgtctatcaacaatgcaaagatcagtgacgaaaagagatttgtgtgcatgctagtgaccgaggacaacgtgtttgaggcacctaccctggtcaaggtgttcaagcaaccatctaaacctgaaattgtaaacagagcagcgtttcttgaaacagagcagctaaaaaagttaggtgactgcatttcaagagacagttacccagacggcaacatcacgtggtataggaatgggaaagtgctacagcctgttgatggagaggtgtccatactttttaaaaaggaaattgatccaggtactcagttgtataccatgacttcctccttggagtacaagacaaccaagtctgacatacaaatgccattcacctgttctgtgacatattatggaccttcgggccagaaaacaatttattctgaacaagcaatctttgatatttactatcctacagagcaggtgacaatacaagtactgccaccaaaaaatgccatcaaagaaggggacaacatcacccttcagtgcttggggaatggcaacccacctcctgaggagttcatgttttacttaccagggcaggctgaaggcataagaagctcaaacacttacacactgacagacgtgagacgcaatgccaccggggactacaaatgttctctcatcgaccaaagaaacatggcagcttcaacaaccatcactgttcactacttggatttatccttaaacccaagtggggaagtgaccaagcagatcggtgataccctgcctgtgtcttgcacaatatctgcaagtaggaatgcaactgtggtgtggatgaaggataacatcaggctccgatctagtccatccttttctagtcttcattatcaggatgctgggaactatgtctgtgaaactgctcttcaggaggttgagggactgaagaaaagggagtcgctgaccctcatcgtagaaggaaaacctcaaatcaaaatgacaaagaaaactgatcccagtggactgtctaagactataatctgccatgtggaagggtttccaaagccagctatacagtggaccattaccggcagtggaagcgtcataaaccaaacagaggagtctccttatattaatggcaggtattatagtaaaattatcatttcccctgaggagaatgttacattaacttgcacagcagaaaaccaactggagagaacagtaaactccctgaatgtctctgcgataagtattccagaacacgatgaggcagacgatataagtgatgaaaacagagaaaaggtgaatgaccaggccaaactaattgtgggcattgtggttggtctcctcctcgccgccctcgtcgccggtgtcgtctactggctgtacatgaagaaatcgaaaactgcatcaaaacatgtaaacaaggaccttggtaatatggaggagaataaaaagctagaagaaaacaatcacaaaacagaagcctaagagaggagttgtttagatgtcctgagaaaaaaacatataaagaaattgaagcatgaacgtgattgtatttaagacatatacaaagacaatgacagcaattcatggttcaagtattaagatgttcatcctactaagctgtcctgggatcttagagaattatctcaagtaaaacaatgaaataaagttataaaattacaacaagatttggcagccatgataataggtcatatgttgtatttcgtttgattttccttttctgtaaatgtctgcactgaggatttctttcagtttgccttttatgtaaattttttacgtagctatttttatacactgtaagctttgttctgggagtggctgttaattggatgtacaatgtaatgtttatttcaattgtttatatggatagtctgagcaggtgcggttctgattctgattgctatcagtaatgccccaaactttcttgtgaggatctgaaacccaaaggtggcagttatgagattgggacatggatcttgcccaatcagaagctggttttttttttaaaaaaaaaaacctggagagtcaggagcaccataagatatgatggtctctatgtgccaacgggttccccgaagcgggtcacaaacacatacggcaacaccacatgtgaatgatacttttaaactgacaatttcgtcttctctgaaaaaagacatacacagagtttgtataacactttacttaacgacacttgctagaaaattacattctgtttttaaaaaaaataaggaaaatgtaaagaagaatatctaatatgtcagagaaagttggaaacaaatcacagctcgcatccccatagtcgcagatcacgatgtaaatcactgtaattaaaattggtgttaaatcctttgggttatccactgccttaaaatgacacttatttcctt

SEQ ID NO: 2324 - DNA, 4245 bp, Rattus norvegicus
  Genbank Accession No. NM_031757
ctcggcggctccgcagcggctgcagcgggaggacccggccggagccgccgccgccgccgccgccgccatcgcagccgggcggccgggcccccgccgccgggatgccaaggagccggggcggccgcgctgcgccgggccaggccgcgcgctggagcggctggcgggccccggggcggctgctgccgctgctgcccgcgctctgctgcctcgcggcggcggcgggggccgggaagccggccggggcggacgcgcccttcgccgggcagaactggttaaaatcctatggctatctgcttccctatgagtcgcgggcgtctgcgttgcattcagggaaggccttgcagtcagcagtctccactatgcaacagttttacgggatcccagtcaccggtgtgttggaccagacgacaatcgagtggatgaagaaacctcgatgtggcgttcctgatcatccccatttgagcaggaggaggagaaataaacgctatgccctaactggacagaagtggaggcagaaacatatcacctacagcattcacaattataccccaaaggtgggtgagctggacacacggaaggctattcgtcaggctttcgatgtgtggcagaaagtgaccccgttgacctttgaagaggtgccataccatgagatcaaaagtgaccggaaggaggcagacatcatgatcttctttgcttctggtttccatggtgacagctctccttttgatggggaagggggcttcctagcccatgcctactttcctggcccaggaatcggaggagacactcactttgattcagatgagccctggacactaggaaatgccaaccatgatggcaatgacctcttcctggtggccgtgcatgaactgggccatgccctggggctggaacactctaatgaccccagtgctatcatggcacccttctatcaatacatggagacgcacaacttcaagctgccccaggatgatctccagggcatccagaagatttacggacccccagctgagcctctggagcccacaagaccccttcctacactcccggtccgcaggatccattcaccgtctgagagaaaacatgagcggcagcccaggcctcctcggccacctctgggggaccggccatccactccaggtgccaagcccaacatctgcgatggcaacttcaacacagtggccctcttccgaggggagatgtttgtgtttaaggatcgctggttctggcgtctgcgcaataatcgggtacaggagggctaccccatgcagattgaacaattctggaagggcctgcccgcccgcatagacgcagcctatgaaagagcggacggaagattcgtcttcttcaaaggtgacaagtactgggtattcaaagaagtgacggtggagcctgggtacccccacagcttgggggagctgggaagctgcctgccccgtgaaggaattgacacagctctgcgctgggaacctgtgggcaaaacctactttttcaaaggcgaacggtactggcgttacagcgaggagcggcgagccacagaccctggctaccccaagcccatcaccgtgtggaagggcatcccgcaggctccacaaggggccttcatcagcaaggaaggatattacacctacttctacaaaggtcgggactactggaagtttgacaaccagaaactgagtgtggagccaggctacccacgcaacatcctgcgtgactggatgggctgcaagcagaaggaggtagagcggcggaaggagcgcaggttgccccaggatgatgtggacatcatggtgaccatcgatgacgtgccaggctctgtgaatgctgtggctgtggtcgtcccctgcacactgtccctgtgcctcctggtgctgctttacactatcttccagttcaagaacaagacgggtccccaacccgtcacctactataagcggccagtccaggagtgggtatgagcagcccagagccctctctgtctacccagtctggccagccaggcccttcctcaccagggtctgaggggcagctctagccactgcccactggggccagcagggccctaggccaggttcgtgtgtagctgaagtggtgggtacattggtctaggctgagtgtggggcagggagtgatggtggctatgccccaggttgggtagctggtacccagctgccagccttctgtcctgggtagacccctctctactcaagggaataggccaggccctgtcaggaggcaaggatcatgccaggaggtgcccctgaggtctctgcatcctgtggtgtctgcaagatgccgcagttccagtcccggctgggacccagccctctgaggcaagccagcactagctctcacccccaccccaagatgccaccaatcccagtcccctctgccaacacctgctggtcagatgtcccctcacccctaccctactatcctccaaggctgcagtgcccctgatgccaacacagtgggcaaaggcctgggtttcccctgctagctaacagcagattcctcaggaaacctgctccacctgtcaggtctcctctgagactcagaatttagggtcacatgctgcaggcaaggctgtggcccgctggatctcacaaggacccagctgtcatgtcgtgaatatttaaatgtcctgtcactactgtttaaagtcccattttgcaaaggctacttgaggctttaggtcagctagaggtgactgtcttggtgatgaggccagagtggtggcccttccccaggcactaaggactatggtgctgcaagggccactcgggcatcctgttcaggagactcaacagccagggcaggagctgaccctggttctgggggcggatccaagtttgtgactattctctactccccttccttaatgttgtcccctgccttgctccagcctgtcctctgtggcctgggggctcagtctgactataggtaaagcagagatgattctagagccaccattgtcataaggaccagggcaatctttaaagtactccatccacatccccatctgccctgaggcaactcagtttcagactggaggcatgtttgtgctccaatcttgaccctggaagcccagctcactgggcccatcttcctgcactgctcttacgaaaagggtactcacagccggtagcagccccaggctttgggacttcccctcgctccctaccccaacctacctttcttttgttttaacctgaggcccttcacatctgacagaatccctaagccttggcttgacttgctccaaaaccactgggtgcagtgttgttcgctggctctctgctaagcccaacagtggtaggaggcggccatcagggtgctagtgggtcacagataccaactctgacctctgagcctgcatgggctttgcccctgccctgtggtctctgggatttgggtcagctcgtcctgtagcagatagggactctcgctgggttgggagctaagtgaaatctcttgtcccagaagcacctatgtgggtccatcgtgtcccatctcaccatcgtgttctttctcattttggccaagggcaggctccccagggcaggcggggaacaactgcagagatttcgtgattcataggtttgtagtgttttatactttgcaaagcactttattagctcacacctgtccactcacacggaactcctgtaggctctgagaggctgagggtaattctcctcttaccctcagatgaagcacaaggaggtcttatctgcccctgccatccagtgaccctggctgggtctgtgtccccatctgtgggtccttccagggcctgagatcaatgtctcttctagtcctctcttctgggcctccctcccctagtttcctggtccctctcctcagcttggtgctctcacttcttgaaagctctaggccccgcaggctccctgttgactcctggcattccaaggccagctgagaaagagcaggaggtggaagcaggcagcccaggctgcagatgtgaggggtgcagggccgggcccagagagggctcagcctagaggcttccaatcttggattcttctgcctgtggtcatctgtctgtccatcagcccaggtcagagcagtcagaggggcaaagtactggagcccccccagagctcagcttcccctcagcctgggtgacatcacagcatttcagtgtcggtcacattttaaactgatcagcctttgtacaatgttttttaaatcatttctaaataaaacagaaatacagtgaaa

SEQ ID NO: 2325 - DNA, 1568 bp, Rattus norvegicus
  Genbank Accession No. NM_031776
aagagccagcagctccccgctctgcagccacagggaccgaccgctctgcgcccgcccggtgcaccctctttggtcagtgaacttgcgctgccccgctgctgccatgtgtgcggctcggaggcgcgagctggcgctcatcttccgagggactttcgtccactccacctggacctgccccatggaggtgcttcgcgatcaccttcttggcgtgagcgacagcggcaaaatagtgtttctagaagaatcatctcagcaagaaaagctggccaaagaatggtgcttcaaaccgtgtgagatcagagagctgagccaccatgagttcttcatgccaggccttgttgatacacacatccatgcccctcagtatgcctttgctggaagcaacgtcgacctgccacttttggattggctgaacaagtatacatttcctacagaaaaaaggttccagagcaccgatgtggctgaagaagtctacactagagtcgttaggagaacactaaagaacggcaccaccacggcatgctactttggaacaattcacactgactcatccctgatccttgcggaaattacagataaatttgggcagcgagcatttgtgggcaaagtatgcatggatttaaataacactgttccagaatacaaggagaccaccgaggagtcagtcaaggagacagagagatttgtgtcagaaatgcttcaaaagaattattcaagggtgaaacccatagtgaccccgcgattttctctttcttgcacggagactctgatgagtgaacttggcaacatcgccaagactcatgatctgtacatccagagccatataagtgaaaatcgtgaagaaattgaagctgtgaaaagcttataccctggctacaaaaactacacagatgtctatgataaaaacaatcttctgacaaacaaaacagtgatggctcatggctgctacctttctgaagaagagctgaacgtcttcagtgaacgaggagcatccattgcacattgtcccaactctaatctgtcgctgagcagtggcttactgaacgtgctcgatgtcctgaagcataaagtgaagatagggcttgggacagatgtggctggtggttactcctattccatgcttgacgccatccgaagagcagtgatggtttccaacgtcctcttaattaataaggtgaatgagaaaagcctcaccctcaaagaagtcttcagactagccactcttggaggaagccaagccctggggcttgatcgtgaaattggaaactttgaggtcggcaaggattttgatgccctcttgatcaaccccagagcatcggactctcccattgatctgttttgtggggatttcgttggtgatatttctgaggctgttatccagaagttcctctatctaggagatgaccgaaacattgaggaggtttatgtgggtggaaagcaggtcgttccattctccagctccgtgtaaggcccttggacatccatgacgctctcctgggaggacatgagtctgctatcttccttgtacccagggaccgatcagaaagtatattcaaaaaaaaaaaaaa

SEQ ID NO: 2326 - DNA, 2927 bp, Rattus norvegicus
  Genbank Accession No. NM_031784
cgggccggtccctgggcctgagctccggctccggctggggcgcctgcgatgtctcaagatggcggagctgggcgaattaaagcacatggtgatgagtttccgggtgtctgagctccaggtgctccttggcttcgctggcaggaacaagagtgggcggaagcacgaattgctggccaaggccctgcacctcctcaagtctagctgcgcccccagcgtccagatgaagatcaaagaactttaccgcaggcgctttccccggaagaccctggggccttccgatctctctttgctctctttgccccctggcacctctcctgtaggctcccccagcccccttgcttccattcctcccaccctcctgacccctggcaccttgctgggccctaagcgtgaggtggacatgcaccctcctctgccccagcctgtgcaccctgacgtcaccatgaaaccactgcccttctacgaagtctacggagagctcatccggccgaccacccttgcgtccacctccagtcagaggtttgaggaagcccactttacctttgcactcactccccagcagctgcagcagattctcacatccagggaggttctgccaggagccaagtgcgattataccatacaagtgcagctcaggttctgtctctgtgagaccagctgcccccaggaggactatttcccccctaacctctttgtcaaggttaatgggaaactctgccccctgccgggttacctccctccaaccaagaatggagctgagcccaagaggcctagtcgtccaatcaacatcacacccctggctcgtctctcagccactgttcccaacaccatagtggttaactggtcatctgagtttggacggaattactccttgtctgtgtacctggtgaggcagttgactgcagggaccctgctacaaaagctcagagccaagggtatccggaatccagaccattcccgagcactgatcaaggagaaattgactgctgaccccgacagtgaagtggctactacaagtctccgggtgtcactcatgtgcccgctggggaagatgcgcctgactgtcccatgccgcgctctcacctgtgcccacctgcagagtttcgatgctgccctttatctacagatgaatgagaaaaagccaacatggacgtgccctgtgtgtgacaagaaggctccctatgagtcactgattattgatggtttattcatggaaattcttaattcctgttcggattgtgatgagatccagttcatggaagatggatcctggtgtccaatgaaacccaagaaggaggcatccgaggtttgccccccaccagggtatgggctggatggtctccagtatagcccagtccaggagggaaatcagtcagagaataagaagagggttgaagtcattgacttgacaatcgaaagctcatcagatgaggaagatctgccccccaccaagaagcactgccctgttacctcggctgccattccagcccttcctggaagcaaaggagccctgacctctggtcaccagccgtcttcggtgctgcggagccctgcaatgggtacactgggcagtgatttcctgtctagtctcccactacatgagtacccacctgccttcccgctgggggctgacatccaaggtttagatttattttctttccttcagactgagagtcagcactacagcccttcagttatcacttcactagatgagcaggacacccttggccacttcttccaattccggggaacccctccccacttcctgggcccactggcccccacattggggagctctcaccgcagcgccactccagcacccgctcctggccgtgtcagcagcattgtggctcctgggagttccttgagggaagggcatggaggacccctgccttccggtccctctttgactggctgtcggtcagacgtcatttccttggactgagttatttggattgcaaaatcaatttctactggccctagcactgagcagatacattgtgggttcccaacccctggctgctctgatccctcaggggtcattggtcaaaggccaggccagatcttcatggacacctgcttttggccttatcactgcctaacaaggccagtactcaaagggttaacatttaaccttttgaaaaaggacattggggtctgtttttggaagtgttctttgatgtagcacattcctttgggtagggtaacctaggcagtgggaggcagatggaagggtaggggttcctcacccttcaccagatcttcagcctcttggggaaagggcagtttcctgcccctcccccaggactcctttccgtacccaaacccaaacatctgttctttttcgtccattcccttctctttggccatactgtcaggtggcaggtcagagatggacagacaactctattttgggttgcagatttcttttttgtacataaataagaaaactccaaattatccaaagatgacttcccttgccttttacttcccagtgtgactcgaggaggaaacaaggccttagttgtgatccccaggggctcgggaacagggcgtggcctgcctactgcctgggtctctctatttatatatttaagttcacaatgtttttatgctaaacagtcaagggcctaagcttctagtgacctgtgctcaggcctagattgttcttgcaccttttatgggacatgggggctctgttctccttcccaatactcagcgccccttcagggccaaagccctgtgatgtgatttcactttttatccccagagctgtagcagagttctcgcctacaataaaggttgtgaatgttctgtgagcgtcatggaggggagagatgttgtaccttgttttccagacccatggtttgtggggcagagggtccatgttctatcctttcacttagaaaaaaaaaaaaaaaaaaaaa

SEQ ID NO: 2327 - DNA, 2089 bp, Rattus norvegicus
  Genbank Accession No. NM_031785
ctatgatggcggcaacagtggtatctcggatacgaaccgggacacggtgggctccagtcctgtggctgcttctgtcgttggtggcagtggcggcagcagtggctgcggagcagcaggtgccactggtactgtggtcgagtgaccgggacctctgggctcctgtggccgacacacatgagggtcatattaccagcgatatgcagctttctacctacttagaccctgccctggagctgggcccccgcaatgtattgctgttcctgcaggacaagctgagcattgaggatttcacagcatacggtggtgtgtttggaaataaacaggacagtgccttttctaacctggagaatgccctggacttggccccctcctcactggtacttcctgctgtggactggtatgcaatcagcactctgaccacctacctacaggagaagcttggagctagtcccttgcatgtggatctagctaccctaaaggagctgaagctcaatgccagccttcctgccctgctgctcatccgtctgccctacacagccagctccggtctgatggcgcccagggaggtccttacaggtaatgatgaggtcatcggacaggtactgagcacacttgagtctgaagatgttccttacaccgcggctcttactgcagtccgcccttctagagtggcccgtgatgtagccatggtggctgggggtctaggtcgccagctgcttcagactcaggtggcatcacctgcgatccatcctcctgtgagttacaatgacactgccccaaggatcctgttttgggcacaaaacttctctgtggcatacaaagacgaatggaaagacttgacctccctcacctttggtgtggagaatcttaacttgaccggctccttctggaatgactcctttgccatgctttcactgacctatgaaccactctttggtgcaacagtgacattcaagttcattctggctagtcgcttctacccagtatctgcccgatattggtttaccatggaacgacttgaaatccacagcaatggctcggttgcccatttcaatgtttcccaagtcacaggacctagtatctattctttccactgtgagtacgtcagcagtctgagcaagaaaggcagtctccttgtgaccaacgtgccctccctctggcagatgactcttcataacttccagatccaagccttcaatgtgactggtgaacagttctcctatgctagcgactgtgctggcttcttctctccgggcatctggatggggctgctcaccaccctcttcatgcttttcatattcacctatggtctgcacatgatactcagcctaaagaccatggatcgctttgatgaccgcaagggccccaccatcactttgacccagattgtgtgacatataccagagagggattgagggagtattggtgtctaggtttccattttgtgacacagtggatggaaaggtttgtcctcttcctactatagcatgaaccctacatacaccaccctcagcctgtcttgcttcctctttcctggacagggacttccctgaggctatcccccacttctaccaacaaagtgtattattcttcatagataaatcttccaggcttcatcaagaggggaagggaccttaattctagggtgcccccctttccctttctccttatttattcttgcccctctgctattatttcgtgctgtttatagtgcttttgtgtagtaaatactcactccccaagctttatggagctttccagcaatagccatgaacttgaggtcccttgaatttgagaggtgtggaaaggctagttaactgtccagcttagcctttatgggttttttttttttggcgggtgggggttaagaatgagcggtacactggggtttatttctgtgacctgagaaggaagaaatcaccacgagaactggagaaacaaagtgtactcattgggtttctggtttgttctcacaaggattgcctgtcaagaagccagaagtatgtgtgtgtgtgtgtggggggggtgtgctctgttgtttcattcctaataaaataaagacgtgttgccatgaaaaaaaaaaaaaaaa

SEQ ID NO: 2328 - DNA, 2307 bp, Rattus norvegicus
  Genbank Accession No. NM_031789
gccgccgcctcacctctgctgccagtagcctcgccgtcggggagccctagcgcagcgtccgccctcagcatgatggacttggaattgccaccgccaggactacagtcccagcaggacatggatttgattgacatcctttggaggcaagacatagatcttggggtaagtcgagaagtgtttgactttagtcagcgacagaaggattatgagctggaaaaacagaaaaaactcgaaaaggagagacaagagcaactccagaaggaacaggagaaggcctttttcgctcagttacaactggatgaagagaccggagaattcctcccaattcagccagcccagcacatccagacagacaccagtggatctgtcagctactcccaggttgcccacattcccaaacaagatgccttgtactttgaagactgtatgcagcttttggcagagacattcccatttgtagatgaccatgagtcgcttgccctggatattcccagccacgttgagagctcagtcttcaccacccctgatcaggctcagtcactcgatagctctctggagacggccatgactgatttaagcagcatacagcaggacatggagcaagtttggcaggagctattttccattcccgagttacagtgtcttaatacggaaaacaagcagcaggctgagactaccactgtccccagcccagaggccacactgacagagatggacagcaattaccatttttactcatcgatcccctcactggaaaaagaagtggacagctgtagtccacatttccttcatggttttgaggattcttttagcagcatcctctccacggatgatgccagccagctgaactccttagactcaaatcccaccttgaacacagatttcggtgatgaattttactctgctttcctagcagagcccagtggcggtggcagcatgccttcctctgctgccattagtcagtcgctctctgaacttctgggcgggcccattgagggctgtgatctgtccctgtgtaaagctttcaaccagaagcacactgaaggcacggtggagttcaatgactctgactccggcatttcactgaacacaagtcccagccgagcatccccagagcactctgtggagtcttccatttacggagacccaccgcctgggttcagtgactcggaaatggaagagctagacagtgcccctggaagtgtcaaacagaatggacctaaagcacagccaacacattcttctggggatacagtacagcctctgtcgccagctcaagggcacagtgctgctgtgcacgaatcccagtgtgaaaatacaacaaaaaaagaagtacctgtgagtcctggtcatcaaaaagtcccattcacaaaagacaaacattcaagccgattagaggctcatctcacaagagatgagcttagggcaaaagctctccatattccattccctgttgaaaaaatcattaatctccctgttgatgacttcaatgaaatgatgtccaaggagcaattcaacgaagctcagcttgcattaattcgagatatacgcaggagagggaagaataaagttgccgctcagaactgtaggaaaaggaagctggaaaacattgtagagctggagcaagacttgggccacttaaaagacgagagagaaaaactactcagagaaaagggagaaaacgacagaaacctccatcttctgaaaagaaaactcagcactttgtatctggaagtcttcagcatgttacgtgatgaggatgggaaaccttactctcccagtgagtactctctgcagcagaccagagatggcaacgtgttccttgttcccaagagcaagaagccagatacaaagaaaaactaggttcgggaggatggagccttttctgagctagtgtttgttttgtacggctaaaacttcctactgtgatgtgaaatgcagaaacactttataagtaactatgcagaattatagccaaagctagtgtagaaataatatgaaactttacaaagcattaaagtctcaatgttgaatcagtttcattttaactctcaagttaatttcttgggcaccatttgggctagtttctgtgtaagtgtaaatactacagaacttatttatactgttctcatttgttacagtcatagacttatatgacatctggctaaaagcaaactattgaaaactaaccaaaccactatacttttttatatactgtatgaacaagaaatgacatttttatattaaattgtttagctctgataaaaattaaaaggagctagcactaataaaggaatatcatgactt

SEQ ID NO: 2329 - DNA, 5952 bp, Rattus norvegicus
  Genbank Accession No. NM_031790
gaattcgggcctagacattgccataaatcctttaaatctttaccagaggaggccctggatttaaaacggcccgtttctcagcacgacccagcccgatgtctgcttcttccggcaggcggcctgggtcctcctcacctggggctgagaagcgtcccatctgctcggagtgaggcgaagtctgtcttcctagtcctttaaaactcctgcttatgtcactgcggccactgtgctgactatgctcacgtctcttaatgcaactctctgaaagcccaataagaaaccactgctcgtgtgggactcctaagagttcagacgaatcattgtctctcagcctggccctggatctgtcctctaggtctttgcaaggagatggggggaccaagatggatttaggataaaattaaactggcatccgtataagccagaccgataccaaaaaaaaaaaaaaaaaaaaaaaaaaaaaaaaagcaaacaggtggaccatgatggcggtggcttcttggctcagtgtgctagagaagtgactgcgcagcaggacttggatgacaggactgacagcctttggtgactgtctttttgaagaactgtacgctcctgggtgaagaagcaatgatggagcaggaaatggcccggttgcatcgcagagtgtcagaggtggaggctgtgcttagtcagaaggaggtggagctgaaggcctctgagactcagagatccctcctggagcaggaccttgccacctacatcacagaatgcagtagcttaaagcgaagtctggagcaagcgcggatggaggtgtctcaggaggatgacaaagctcttcagcttctccacgacatcagagagcagagccggaagctccaggagatcaaggagcaggagtaccaggctcaggtggaggagatgaggctgatgatgaatcagctggaagaggacctcgtgtcagcccgaagacgcagcgatctctacgagtctgagctgagggagtctcggctcgccgccgaggaattcaagcggaaggcaaacgaatgtcagcataaactgatgaaggctaaggacctagggaagcctgaagtgggagaatgttccagactggagaagatcaatgctgagcagcagctgaagattcaggagctccaggagaagctggagaaggctgtaaaagccagcaccgaggccacagagctcctgcagaacatccggcaggcaaaggagcgagctgagagggagctggagaagctgcacaacagggaagattcttccgaaggcatcaaaaagaaactggtggaagctgaggaacgccgccactccctggagaacaaggtaaagagactagagaccatggagcgtagagagaacagactgaaggatgacatccagacaaagtccgaacagatccagcagatggctgataaaattctggagctggaggagaagcatcgggaggctcaggtctcagctcaacacctagaagtacacctgaagcagaaggaacagcactatgaggaaaagatcaaagtgttggacaatcagataaagaaggacttggccgacaaggagagcctagagaccatgatgcagaggcacgaagaggaggcccacgagaagggcaagatcctcagcgagcagaaggcgatgatcaacgcaatggattccaagatcagatccctggagcagaggattgtggagctgtcagaagccaacaagcttgcggcaaacagcagtctcttcacccagaggaacatgaaggcccaggaagagatgatctcagaactcaggcagcagaaattttacctggagacacaggccgggaagctggaggcccagaaccgaaaactggaagagcaactagagaagatcagccaccaagatcacagtgacaagaatcggctgctggagctggagacaaggttgagagaggtcagcctggagcatgaggagcagaagctggagctgaagcggcagctcacggagctgcagctgtccctgcaggagcgtgagtcccagctgacggccctgcaggccgcccgggctgcccttgagagccagctccgccaggcgaagacggagctggaggagacaactgcagaagcggaggaggagatccaggcactcacggcacatcgagatgaaatccagcgcaaattcgatgcccttcgcaacagctgtactgtcatcaccgacctggaggagcagctgaaccagctcaccgaggacaacgccgagctcaacaaccaaaacttctacctgtccaaacaactcgatgaggcttcgggtgccaacgatgagattgtgcagctgcgaagcgaggtggaccatctccgccgtgagatcacggagcgggagatgcagctcaccagccagaagcaaacaatggaggctctgaagacgacctgcaccatgctggaggagcaggtcatggacctggaggccctgaacgacgagctgctggagaaggagcgccagtgggaggcctggaggagcgtcctcggggacgagaagtctcagtttgagtgtcgagttcgagagctacagaggatgctggacaccgagaagcagagcagggctagagctgatcagcggatcacggagtctcgccaggtggtggagctggcagtgaaggagcacaaagccgagattctcgcgctgcagcaggctctcaaagagcagaagctgaaagctgagagcctgtcggacaagctcaacgacctggagaagaagcacgccatgcttgagatgaatgcccggagcttacagcagaaactggagacagagcgggagctcaaacagaggcttctggaggagcaagccaagttgcagcagcagatggacctgcagaagaaccacatcttcagactgacacaagggctgcaggaggcgctggaccgggcggatctgctgaagaccgaaaggagcgacctggaatatcagctggaaaacattcaggttctctactcacacgagaaggtgaaaatggaaggcactatttctcaacaaaccaaactcattgatttcctgcaagccaaaatggaccagcccgctaaaaagaaaaagggtttatttagtcgacggaaagaggaccctgctttgcccacacaggttcctctgcagtacaatgagctgaagctcgccctggaaaaggagaaagcgcgctgtgcggagctggaggaagcccttcagaagacccgcatcgaactccggtccgcacgggaggaagctgctcaccgcaaagccacggaccacccgcacccatctacgccagccactgcgaggcagcagatcgccatgtccgccatcgtgcggtcgcctgagcaccagcccagtgccatgagcctgctcgccccaccatccagccgcagaaaggaggcgtcaactccagaggagttcagccggcgtcttaaagaacgtatgcaccacaacattcctcaccggtttaacgtgggcctgaatatgcgagccaccaagtgcgccgtgtgtctggatactgtgcactttggacgccaggcatccaaatgtctcgaatgtcaggtgatgtgccatcccaagtgttccacctgcttgcccgccacctgtggcctacctgccgaatatgccacacacttcaccgaggccttctgccgagacaaagtgagctccccggggctccagagcaaggagcccagcagcagcttgcacctggaagggtggatgaaagtgcccaggaataacaaacgaggacagcaaggctgggacagaaagtacattgtcttagagggttcaaaagtcctcatctatgacaacgaagccagagaagctggacagaggccggtggaagaatttgagctgtgccttcccgacggggatgtatctattcatggtgccgttggtgcttctgaacttgcaaatacagccaaagcagatgtcccatacatactgaagatggagtcccatccgcataccacctgctggcctgggagaaccctctacctgctggcacccagctttcctgacaagcagcgctgggtcacagccctagagtctgtcgtcgcaggtgggagagtttctagggaaaaggcagaggccgatgctgcatgggactgtacttcttgtgagcgtctgcccgtgtgggttgagaaattacttggaaactctctgctgaagctggaaggtgacgaccggcttgacatgaactgtaccctgcccttcagcgaccaggtggtgctggtgggcaccgaggagggcctctatgcgctgaacgtcttgaaaaactccttaacccacatcccaggaatcggagcagtcttccagatttacatcatcaaggacctggagaagctgctcatgatagcaggggaagagcgggctctgtgtttggtggacgtgaagaaggtgaagcagtcgttggcacagtcacaccttcctgcccagcctgacgtctcccccaacatatttgaagccgtcaaaggctgccacctgtttgctgctggcaagatcgagaacagcctctgcatctgtgccgccatgccgagcaaagtcgtcatcctgcgctacaacgacaacctcagcaagttctgcatccgcaaggagattgagacctctgagccctgcagctgtatccacttcaccaattacagtatcctcatcggaaccaacaagttctatgagatcgacatgaaacagtacacgcttgaggagttcctggacaagaatgaccattccttggcacctgctgtgttcgcatcctcgaccaacagcttccccgtctccatcgtgcaggcaaacagcaccgggcagcgggaagagtacctgctgtgtttccacgaatttggggtgttcgtggattcttatggaagacgtagccgcacagacgatctcaagtggagtcgcttacctctggccttcgcctacagagagccttatctgtttgtgactcactttaactccctggaagtaattgagatccaggcacgttcctcactggggacccctgcccgagcctatctggaaatcccaaaccctcgctacctgggccccgcaatttcctccggagcaatttacctggcctcctcataccaggacaagttaagggtcatatgctgcaaaggaaacctcgtgaaggagtctggcactgagcagcaccgcgtgccctccacatcccgcagccctaacaagcgaggcccaccaacatacaacgagcacatcaccaaacgtgtggcctccagcccagcgccaccagaaggccccagccatccccgagagccaagcacaccccaccgctaccgagacagagagggccggacagagctgcgcagggacaagtctccaggccgtcctctggagcgggagaagtcgccaggccggatgctcagcacgaggagagagcggtccccggggagactgtttgaagacagcagcaggggccggctgcctgcgggagccgtgaggaccccactgtcccaggttaacaaggtctgggaccagtcttcagtataagtctcagcctgaagaactcctcctcatctcagtctgcaggaagacaactgcgccctgggtctccaccgcaggggatcccagcaccgtctgctcgccgcattcggcacagctgggtccagactgtccttggcacggatacccccatctccgaggggtgcagatagccaaggctcttaggcgctgccagcgctcagttcccccctcggaggggggagcaccctcctgcggtcatctctgcactgttactctctcacagcattcacagacttttgtacttagctccagcctgaacccattcatcaaaaggaaaccaacccagactcgaaccgtggctggaagtccactgctactcttaagatccttgggttggttattttttatttttccctttggttttgatcatctcctcctcttcttcttcctccctcttgttcctcttcctcctcctttctccttttttttttttttaagacaacagaattc

SEQ ID NO: 2330 - DNA, 1740 bp, Rattus norvegicus
  Genbank Accession No. NM_031797
tggaacacgggttggggcggcagctgaagacgccaacttaaaagcgccgtagccagaacccaggcagcagtgtgtccattgtccagaactcatctgagaaactgccacaggaagtgctgctctgctccagtctggtcactgaaaagggagctccaggacctgcaggatgggggcaggctgtgtcaaagtcaccaagtacttcctcttcctcttcaatctgctgttctttatcctgggtgctgtgatcctgggctttggggtgtggattcttgcagacaagagcagcttcatttccgtcctacaaacctcatccagctcgctgcaggtgggggcatacgtcttcattggtgtgggcgccatcaccatgctgatgggcttcctgggctgtattggtgctgtaaacgaggtccgctgcctgctgggtctgtacttcgtctttcttctgctgattcttatagcacaggtgactgtagaggtcctcttctacttcaatgctaacaagctgaagcaggagatggggaacacagtgatggacattattcagaactacagcgtcaatgccagcagcagccgcgaggaggcttgggactatgtgcaggcgcaggtgaagtgctgtggctgggtcagcccctccaactggacacgtaacccggtgctcaagaactctaccaagaccacttacccatgctcctgtgagaagacgaaggaggaggacaaccagctcattgtgaagaaagggttctgtgagtctgacaacagcaccgcaagtgaaaacagtcctgaggactggcctgtgcacccggaggggtgcatggagaaggctcaggcgtggctacaggagaacttcggcatccttctgggcgtgtgtgctggtgttgctgtcattgagctgctggggttgttcctgtccatatgtttgtgccggtacattcattctgaagattacagcaaggtccccaagtactgaggctgctgatgtccccactgtcctgtgtttctccaccctcagtctcccacagggcctctagagctttcccacatgagccgtgctccatctactactgaggcctctggcccaccctgggaaggttgtaggaactttctgggcctgggcccttctccctgcctttctgccaccaatatggggcccttactgtcctgtagctcttcctcctactgcctggaatatttttaacagcttgaaatggctcccagtattactgtacacaggatagctgggtccccaccctgaagtcatattataacaatataatattaaaaaccagggagggctagcacccatggctgcccagggaaaggccacaggaaaggttagtggtttccccactgtgacactttctttatgggttttcaatgtttctgtgggagacagggtaggcagttcttgtacacacttggaatactccccccaagctcagttcagcagggaactgaacggagaggctgcctgggggactggcccaggtagcccccagtgagcttttccttggtgagggacctgacagcttaggggcatgggtccctcaggtctggcataagaccctgagttgtctggacaagagaaggaggatctggactggtatttcttggcagctgtcccctgtcccctgggctaagggtgggtgaggctgtgccttgcagggtgggggagggtttccatatgctcatctctgaaatcaactattaaaggaggatttgtaacaaaaaaaaaaaaaaaaa

SEQ ID NO: 2331 - DNA, 6402 bp, Rattus norvegicus
  Genbank Accession No. NM_031798
tgtgaggcagcggcgctgcgactctctctcccccggctccttagtgggagcgccggccagggacccgagccgcgctgtacgcagcgtccacccgcccgctccgcaggtccccgagcgtcgggcggcgatggagcccgggcccgcggcgccctcgtctggcgccccgcggcccgcccgggatggggacgcgccgctgactgccgccggggtggacctgcccggcacggccgtactctccggtcgagaggatgctaccgctgggagccaggccggcggcggggtgcgcggagagggaaccccggccgctggcgatgggctgggcaaacctctggggcccacccccagccagagccgcttccaggtggacccggtttccgagaacgccgggcgggccgcggctgctgcagctgcagcggcggctgcggcggctgccggggcagcgggcaaggagacccccgcggctgggaaagccggcactgagagcggcgtggccaagggcagcgaggaagccaagggccgcttccgcgtgaacttcgtggacccggctgcctcctcgtcggcggacgacagcctgtcggatgcggcgggagtcggtggcgacgggcccaacgtgagctcccagaacggcggggacacggtgctgagcgagggcagcagcctgcactcgggtggtggcagtggacaccaccagcagtactactatgacacccacaccaacacttactacctgcgcaccttcggccacaacaccatggacgcggtgcccaggatcgaccactaccggcacacggccgcgcagctgggcgagaagctgctccggcccagcctgggagagttccacgatgagctggaaaaggaaccttttgaggatggttttgcgaatggagaagaaagtactccaaccagagatgctgtggtcacatacactgccgaaagtaaaggagttgtaaagtttggctggatcaagggtgttttagtacgatgtatgttgaatatttggggtgtgatgctctttattcgattgtcatggattgtgggtcaggctggaataggtctctccgttcttgtaatagcaatggccactgttgtgacaaccatcacaggattgtctacttcagcaatagctaccaatggattcgtgagaggaggaggagcatactatttaatctctagaagtctagggccagaatttggcggtgcgattggcttgatcttcgcttttcccaatgcagtggcagttgctatgtatgttgttggattcgcagagactgtagtggagctgcttaaggaacattccatacttatgatagatgaaatcaatgacatccgaattattggagccattacagtggtggttcttctgggcatctcagtggccggaatggagtgggaagcaaaggctcagatcgtccttctggtgattcttcttctggccatcgctgacttcgtcataggaacatttatctcactggacagcaagaagcccaagggtttctttggctataaatctgaaatatttagtgagaactttggaccggattttcgagaagaagagactttcttttctgtattcgccatcttttttcctgctgcaactggtattctagctggggcgaacatctcgggtgaccttgcagatcctcagtcagccatacccaaaggaacgctcttagccattttgattacgacagtggtttacataggaatcgcagtgtctgtaggttcttgtgttgtccgggatgccactgggaacgttaatgacaccattacaacagagctaactaactgtacttctgcagcctgcaaattaaactttgacttttcctactgtgaaagcaacacctgttcttatgggctaatgaacaactttcaggtgatgagcatggtgtcaggatttgcacccctgatctctgcgggtatcttttcagccacactctcatcagcactggcatctcttgtgagtgctcccaaaatatttcaggctctatgtaaggacaatatctacccagctttccagatgtttgcgaaaggttatggaaaaaataatgaacctcttcgtggttacatcttaacattcttaattgcacttggattcatcttaattgctgaattgaatgtcattgctccaattatctctaatttctttctcgcatcatacgccttaatcaacttttctgtattccatgcgtcacttgcaaagtctccagggtggcgtcctgcgttcaagtactacaacatgtggatctcccttactggagcgattctctgctgcatagtgatgttcgtcattaactggtgggctgcactgctcacatatgtgatagttcttggactgtacatttatgtcacttacaaaaagccagatgtgaactggggatcctccacacaagcgctgacttacctcagcgcactgcagcattcaatccgtctttccggggtggaggaccatgtgaaaaacttcaggccacagtgtcttgtaatgacaggttctccaaactcacggcctgctttactgcatcttgttcatgacttcacgaaaaatgttggtttaatgatctgtggccatgtgcatatgggtccccgaagacaagctatgaaagagatgtccattgatcaagccaaatatcagcgatggctcattaaaaacaaaatgaaggctttctacgctccggttcacgcagatgacttgcgggaaggtgcacagtacctgatgcaggctgctggacttggtcgtatgaaaccaaacacacttgtcctcggatttaagaaagattggttacaagcagatatgagggatgtggatatgtatataaacttatttcatgatgcttttgacatacagtatggagttgtggtcattcgcctaaaggaaggactggatatatcacacctccaaggacaagaagaattattgtcatcacaagaaaagtcacctggtaccaaggatgtggtagtaaatgtggactacagtaagaagtcagatcaagatgctttcaaagcatctggtgaaaaacctattacacagaaagatgaggaagaggatggcaagacttcaactcagccactgttgaaaaaagaatccaagggccccgtggcacctttaaatgtagctgaccaaaagcttcttgaagctagcacacagtttcagaaaaaacaagggaagaatactatagatgtctggtggctttttgatgatggaggtttgaccttgttgataccctatcttctgacaaccaagaaaaagtggaaagattgtaagatccgagtattcattggtggaaagataaacagaatagaccatgaccggagagcgatggctactttactcagtaaattccgaatagacttctccgatatcatggtcctaggagacatcaacaccaaaccaaaaaaggaaaacatcgtcgcttttgatgacatgattgagccatacagacttcacgaggatgataaagagcaggatattgcagacaaaatgaaagaggatgagccctggcgcatcacagacaacgagctggagctctacaagaccaagacatatcggcagatcaggttaaatgaattattaaaggagcattcaagcacagctaatattattgtcatgagtcttccagttgcccggaagggtgctgtgtccagcgcgctgtacatggcttggttagaagctctgtctaaggacctgccaccaatcctgctggttcgtgggaatcatcagagcgtccttaccttctactcttaattgtcctgccccatggactccctctaagaatggtacttcagtgcctagtcagagtgactggatcgtcagcaacaccgcagcatcacagtggcgaactgggtctttgtttcactacttcattctttgaaagcacatggacacgttgctccactgatagatctgtggagacttcggttttagtctactccagatctcagtcttatgactgctgattcttccttgttggactgaagttcttgagagtaaagttttcctttgctacttgacagcaataagagtgagttatttttgattgctgaaaggagtacataagcctttagccttgaggtgccttctgaaattaaccaaatttcatccatagatctatcgtcttttgtacatttatagaatgttaaactctgccttcagacattatttttacttctaatctctgtcatcctaagtggacactgcttgtctcctcccattgaccagttagtgttgagagctgtgtgtttcgtattacttttgtaaaagcgtttgttggatactgaagagggtaggacaagctaataaaatatgtggagaaagtatccaaaaatggagcccaaggttaggtttatatgaatagatacttagagctagggaagagaggcccgaacaccgtttctatctctcaattagagttatctattatttcttttaaatcatagagatgactgacgatctacccagtacttcatttataacataaaaaaaaaaaatcacatttttttaaagcaaaaccttgaggtcatttgtattgtttttaaaagatctcttttaatttagaatttcctctcaaatgggagggacttttaagacatgctaactggtatttttcgaggaaatttagacaaagcattgccatttactagagcatttcaataaaaactatggggatttcactatcctatcgcatcctttatttaaaaagaaagatgacaatgttatcaatggttaaatggaccactgttttcttagtgaaatggttttaggcttaatttattcaagtatcaagaacatttagtcttaatacactcaggtttgaacagattattccgaacattgaaatttaatccattcttaatactttaaaacttgcgttaaagaaaactgccagtttgtgcatttgaccttgtcgtctgcaagtgcacttgacagtgagcgtgcacacctgcgctgtcctgaacgctttatacacagtcgttaatgtgaagtgtctaagttcaaggaaggatcttctaaacatttcaagggattcatgtccacatgtctgtctgtgtgtatgttttgcatacacaggtgcatatgtgtatatgtaatgaaatttatgttgccagtgtttcagattttaaagcgatcatgatttggtaggttacagattttgttgttgttgttgttttagttttttcttttcttttttaagtaagcattcaagtcagatcaagacattacagatttcatggaggacaaagacaattgaaagaacatcgtgtagctttgtacagttatccagttatgtaaagtagatgatctgtaagtttcagtggagaacatagcgcagactttcatcatcttaagggaaatgtcagaaaagcatttcagtagtgtagtacttgtgctccatgaaaacagactgcgttaataccagctggatatcttctcgtttccactcagaatattaaagaaaacaaggttaagtgattttttccaagttcttcttacattataatataatattgttccatttattgtaaattttgcagagtttagggcagtatagaagaatcatattagcaaaccatatcatgtgtggatcttctgaatggatactagggcatgggctgaatgctgctatcttgaaatgtacacagctagacttgccttttatttttaaaggttttccctcattcaggaaacttcattgtgatctgtactacagaaactaaatgtcatacatcatacgtgtgtgttcaaagtacataaaatggatctcaacgcacctaacagggagggtggcgacactgtgaagtgatgccagcagcagctctctactcttgaaaaccgccttccgtcgtcagctaacacgagctgccaggccagacgttctcaaggttgcagtagtactctaaaacgaaacttctcaatggttaattcttagacatctagctagtattagagctgttttcattttacgctgtttggattatttggatgccaaattatgttttagtcctaatcattgataataacttaaaaatacgcagtggcatttgagctcattcttgggataagttaaaaacttgagtgcgttcaaagagaacgtcgttgatgattaacggttcactaaatcagatattcatttgtctcatcttttccttcctgctttgttttccttcactcttctcatatggctctcctgacgtgtgtgtggtttgttttgttttgtttttttaagactatggaaataatttaatgagttgagctccggtgatgatctgctaagtttgaaaatgtaatattttgataatactgtactgtacctgtcccaaatgcttttgtaatgttttaaccccgagtattgcagttgctgctccgtacagaggttactgcaataaaggaagtggaatcattaaaacttt

SEQ ID NO: 2332 - DNA, 416 bp, Rattus norvegicus
  Genbank Accession No. NM_031810
atctgtcagctcaactacctgggagtctcacgtcctctctgcactctggaccctgacttcaccgacatgaaaactcattactttctcctggtgatgttattttttctcttctcccagatggagctgggtgctggcattctcacaagtcttggacgcagaacagatcaataccgatgcctccaaaatggaggattctgtctccgctccagctgcccatctcataccaaactacaaggaacatgtaaaccagataagcccaactgttgcaggagttgacagtggtttgaagaatggacataaaggacagcaagggattgtaaaattagtgttttaataaatgaaatgtttttgaagtttatttacatcatctcaaaataaattttatgcctcagtttaaaaaaaaaaaaaaaaaaaaa

SEQ ID NO: 2333 - DNA, 1536 bp, Rattus norvegicus
  Genbank Accession No. NM_031817
ttgaaactgaagcaatctcaacaggagaagaaatgggctgtttacgtccaatatatgtcctcttcttctgttttgtagttagagtatacggccaatatgaagcttaccagtgggatgaagattatgagcaagagccaagtgaggattatgagccagaattccagtttcaccaaaatatcgaatatggagctcccttttatcagaatattttaggttgtgctaaggaatgcttctgtccaactaactttccaacatcaatgtactgtgacaaccgcaaactcaagactatcccagatattccaatgcacattcagcaactcaaccttcagttcaatgatattgaggctgtgactgcagattcattcatcaatgcaactcatcttaaagaaattaaccttagccacaacaaaattaaatctcaaaagattgattatggtgtgtttgctaaactttcaaatctacagcaacttcatctagatcacaataacttagaagaatttccatttcctcttcctaaatctctggaaagactccttcttggttataatgaaatctctacacttccaacacatgccatggatgggctggtaaatgtcactatgcttgacctctgctataaccatctctctgactccacgttaaaaggaaagattctttccaaactggaaaagctcatgcagcttaacctgtgcaataacaggttagagtcaatgccccctgggttgccgttatcacttatgtatctatctttagaaaataattcaatttcatctataccagaggattactttcagaaacttccaaaacttcatgctctaagaatatcacacaacaaacttgaagacattccatatgacatctttaatctttccaatcttatagaactcaatgttggacataacaaactgaagcaagcattctacattccaaggaatttggaacatctatacctacaaaataatgaaatacaaagcatcaatgtgacaatgatgtgtccttctcttgatccattacaccatcaccatttaacataccttcgtgtggaccaaaataagctgaaggaaccaataagttcatatatcttcttctgcttccctcggatacacagtatttattatggtgagcagaggagcactaatggtgaaacaatacaactgaagacccaagttttcaggcgctatcaagatgaggaagaggaagaggaagacgacagtcaggaccacactcttgagggtcaagaagaaacagaagagcactttaattctcattactatgaaatgcaagcatggcaaaatactatataggtacatatttatgactccataaagccttaataattacaaatgtaagcgtatacctgctcataataatatatctagaagtatgtgctagtataaagacccgaattgcatttgagatgttagtgagaatggttttacttcataggcgtagtgcttactagaaacgatgcaaaccttaagaaatataaagtagaatggcaagtgggaataaacaaaactaagctcaaaaaaaaaa

SEQ ID NO: 2334 - DNA, 2781 bp, Rattus norvegicus
  Genbank Accession No. NM_031821
ccacgcgtccgggagccggacgtcggactagagagtagggagagcgattggggctcgagggacagggctagaccggacgcgtgtccgcgcctcggaggtggcagtaggtagtgtcgggtagcgaggcaacgatggagctcctgcggactatcacctaccagccggccgccggcaccaagatgtgcgagcaggcgctgggcaaagcttgcggcggggactcaaagaagaagcgaccgcagcagccttctgaagacgggcagtcccaagcccaggtgaccccggcggccccacaccaccatcatcaccattctcactccggacccgagatctcgcggattatagtcgaccccacgacggggaagcgctactgccggggcaaagtgctgggcaagggtggatttgcaaagtgttacgaaatgacagatctgacaaacaacaaagtctacgctgcaaaaattatccctcacagcagagtagctaaacctcatcaaagggaaaagatcgacaaagaaattgagcttcacagaatcctgcaccataagcatgtagtgcagttttaccactactttgaagacaaagaaaacatttacatcctcttggagtactgcagtagaaggtccatggctcatatcttgaaagcaagaaaggtgttgacagagccagaagtccgatactacctcaggcagattgtgtcgggactcaagtatcttcacgaacaagaaatcttgcatagggatctcaagctagggaacttttttattaatgaggccatggagctgaaggttggagacttcggcttggctgccagactggaacctttggaacacagaaggagaacaatatgtggaaccccaaattatctctcccctgaagtcctcaacaaacaaggacatggctgtgaatcagacatctgggccttaggctgtgtaatgtatacaatgctgctaggaagacctccattcgaaacaacaaatctgaaagaaacgtacaggtgcataagagaagcaagatatacaatgccgtcttcattactggcccccgccaagcacttgatagccagcatgctgtccaaaaacccagaggaccgccccagtttggatgacatcattcggcatgacttctttctgcagggcttcactccagacagactctcttctagctgttgccacacagttccagacttccacttgtcaagcccagctaagaatttctttaagaaagctgctgccgctctttttggtggcaaaaaggacaaagcaagatataatgacacacacaataaagtgtctaaggaagatgaagacatctacaagcttcggcatgatttgaagaaaacatcgataacccagcaacccagcaaacacagaacagatgaggagctccagcctcctccaactacctttgccaaatctgggacatccgcagtggaaaacaaacagcagattggagatgcaatccggatgatagttagagggacgctgggcagctgcagcagcagcagtgaatgccttgaggatagcaccatgggaagtgttgcagacacagtggcaagagtccttcgagggtgtctagaaaacatgcctgaagctgactgtattcccaaagagcagttgagcacgtcctttcagtgggtcaccaaatgggtcgactactccaacaaatacggctttggataccagctctcagaccacactgttggagtccttttcaacaacggcgctcacatgagcctccttccagacaaaaagacagttcactattatgcggaacttggccaatgctctgttttcccagcaacagatgcccccgaacaatttattagtcaagtgacggtgctgaaatacttttcccactacatggaggagaacctcatggatggtggcgatctccctagtgttactgacattcgaagacctcggctctacctccttcagtggttaaagtctgataaagccttaatgatgctcttcaatgacggcacatttcaggtgaatttctaccacgatcatacaaagataattatctgtaaccaaaatgaagaataccttctcacatacatcaacgaagacaggatatctacaactttcagactgacgaccctgttgatgtctggctgttcgctagaattgaaacatcgaatggaatacgccctgaacatgctcttgcagagatgtaactgaaaaacctcttttagagcggacctcgtgggggctcttttccactgtgagatcaacagggaagccagtggagggataacggagcatgttagagaaatcggacaggtgctggtacgaatacgagtcgtctgtggcctgctggactgctggaaccagaccagcctaaggtggacagttgactttgggcaatcttaagtgtggagccaagtacagttttccttgagatacctgtctttacaaagtttatcggacaattttgcagacagacgctttgactctgaagttctctctgtggagagtgttttcagttggaagacttggaactgtgaataaacttcctgaaggggagggagaagggaggaagctccctcgctgttgaaaggctacaatcagagcagcttttgtttggctgcttaactgtgaactatggccatacatatttttttttttggttatttttgaatacacttgtggctggaaaagtgcattccttgttaataaactttttatttattacagccccaagagcagtatttattatcaagatgtcttttttttttatgttgaccattttgaactcttggcaataaagagtatgaaatag

SEQ ID NO: 2335 - DNA, 948 bp, Rattus norvegicus
  Genbank Accession No. NM_031832
aacagctagcggagcggcaggaggagcactaaccaggaaaatggcagacggcttctcacttaatgatgccttagctggctctggaaacccaaaccctcgaggatggcctggtgcatgggggaaccagcctggggcaggaggctacccaggggcctcctatcctggggcctacccaggacaggctcctccagggggttatcctggacaggctcctcctagtgcctatccgggcccaactggccctagtgcttatcctggcccaactgcccctggagcttatcctggcccaactgcccccggagccttcccagggcaacctgggggacctggagcctaccccagtgctcctggggcctaccccagtgctcctggggcctatcctgctactggcccctttggtgccccgactggaccactgacagtgccctacgatatgcccttgcctggaggagtcatgcctcgcatgctgatcacaatcataggcacagtgaagcccaacgcaaacagtatcactctgaatttcaagaaagggaacgacatcgccttccactttaacccccgcttcaatgagaacaacagaagagtcatcgtgtgcaacacgaagcaggacaataactggggaagggaagaaagacagtcagctttcccctttgagagcggcaaaccattcaaaatacaggtcctggttgaagccgaccacttcaaggttgcggtcaatgatgttcatctgttgcagtataaccatcggatgaagaacctcagggaaatcagccaactggggatcattggtgacataaccctcaccagcgcttcccacgccatgatctaagccagaaggggtgggccggcaccagaactgccctgtgtgttatgagcgggaaactttgcatttctctctccttatacttcttgtaagacatccatttaataaagtctcgtgctgagaga

SEQ ID NO: 2336 - DNA, 1227 bp, Rattus norvegicus
  Genbank Accession No. NM_031834
ggaattcgcaacgcctacacaaagatccctatcactgagcacccggaggcaaggctcagaaccccaggatcagcaacatggagttctcccgtccaccgctagtgcatgtgaagggtatcccactcatcaaatactttgcagagacaattgggccattgcagaacttcacagcctggcctgatgacttgctgatcagcacatacccaaagtctggtactacctggatgagtgagatcctggatatgatctatcagggtggcaagctagagaagtgtggccgcgcccccatctatgcccgggtacccttccttgagttcaaatgtccaggggttccctcaggtcttgaaactttggaagagacaccagccccacggctccttaagacacatctgcccctgtccttgctccctcagagtctgctggatcagaaggtcaaggtgatctacattgcccgaaatgcaaaggatgtggttgtctcctattataacttctacaacatggccaagctgcaccctgatccaggcacctgggacagcttcttggagaacttcatggatggggaagtgtcctatgggtcgtggtaccagcacgtgaaggagtggtgggagctgagacacactcaccctgttctctatctcttctatgaagacataaaggagaaccccaaaagggagatcaagaagattctagagtttttggggcgctctctacccgaggagactgtggattccattgttcaccacacatctttcaagaaaatgaaagagaactgcatgactaactacacaaccatccccactgagattatggaccacaatgtttctcccttcatgaggaaaggtactactggggactggaaaaataccttcactgtagcccagaatgagcgctttgatgcccactatgctaagacaatgacagattgtgacttcaagtttcgttgtgaactatgagtggattatggctatactgggaaccaaggcaaactgacacagcccatcatgatctcaagtaaaatgtgatgtgttcaatctacttgttgtatgcctagaggaaatctgagctaagagaataggattggggatgtggctgaggcagagggttttatcaacgcatgtcaggaaagcaatcagtcccaacacctaaaaagaacctaaagtacaaacatgcaaaaaatagtaagataaactatattttacctgaaagaataaatgccactgggaaatg

SEQ ID NO: 2337 - DNA, 645 bp, Rattus norvegicus
  Genbank Accession No. NM_031836
atgaactttctgctctcttgggtgcactggaccctggctttactgctgtacctccaccatgccaagtggtcccaggctgcacccacgacagaaggggagcagaaagcccatgaagtggtgaagttcatggacgtctaccagcgcagctattgccgtccaattgagaccctggtggacatcttccaggagtaccccgatgagatagagtatatcttcaagccgtcctgtgtgcccctaatgcggtgtgcgggctgctgcaatgatgaagccctggagtgcgtgcccacgtcggagagcaacgtcactatgcagatcatgcggatcaaacctcaccaaagccagcacataggagagatgagcttcctgcagcatagcagatgtgaatgcagaccaaagaaagatagaacaaagccagaaaaaaaatcagttcgaggaaagggaaagggtcaaaaacgaaagcgcaagaaatcccggtttaaatcctggagcgttcactgtgagccttgttcagagcggagaaagcatttgtttgtccaagatccgcagacgtgtaaatgttcctgcaaaaacacagactcgcgttgcaaggcgaggcagcttgagttaaacgaacgtacttgcagatgtgacaagccaaggcggtga

SEQ ID NO: 2338 - DNA, 817 bp, Rattus norvegicus
  Genbank Accession No. NM_031838
aacaccaaatggcggatgacgccggtgcagcgggagggcccggaggacccgggggcccaggattaggaggccgcggggctcgtggaggtaaagctgaagacaaggagtggatccccgtcaccaagctgggccgcctggttaaggacatgaagatcaagtccttggaggagatctacctgttctccctgcccattaaggagtctgaggttattgactttttcctgggtgcatctctaaaggatgaagttctgaaaatcatgccagtgcagaagcagactcgggctggccagcggaccaggttcaaggcctttgtcgctattggggactacaatggccacgttggtcttggtgttaagtgctccaaggaggtagccactgccatccgaggggccatcatcctggccaagctttcgaccgtcccagtgtggagaggctactgggggaacaagattggcaagccccacactgtgccatgcaaggtgacaggccgctgtggctctgtgctggttcgtctcatccctgcccccagaggcactggcattgtctctgctcctgtgcccaagaagctactgatgatggctggtatagatgactgctacacttcagccaggggctgcactgccaccctgggcaactttgccaaggccacctttgatgccatctccaagacctacagctacctgacccctgacctctggaaagagactgtgttcaccaagtctccttatcaggaattcactgaccatcttgtgaaaacccacaccagagtctctgttcagaggacccaggctccagctgtggctaccacataagggtt

SEQ ID NO: 2339 - DNA, 5055 bp, Rattus norvegicus
  Genbank Accession No. NM_031841
ctgggctagggatgggcacaatgcggtgttggtgtctgcagtattctactcctggacaccggtggcctgcaagtgcgcttttggcgtcctctcatttttctatccttatctccgtccgcggctgccttggccagccagtttttgattttttatctgttccttgatcgatacaaagaacctaaggacatacaggacattaatacccaactgccagctctggcccagggcttgtactgtgcagcgggctggctgcagaaacttaagtcataacactctttgtcgctgaggtctgaagctctctgcacgttctcatccctgggaacgtgaccccagcatccgacgccaagatgccggctcacatactgcaagagatctctggctcttactcggccaccaccacaatcacagcgccaccttctgggggacagcagaatggaggagagaagtttgaaaagaatcctcaccactggggagcagatgttcgccctgaaattaaagatgacctatacgaccccagctaccaggatgaggaggggcccccgcccaagctggagtacgtctggaggaacatcatcctcatggccctgctgcacattggagccctgtacgggatcacactggtcccctcctgcaaggtctacacctgcctctttgcatatttgtactacgtaatcagcgccctgggcatcacagccggggctcatcgcctgtggagccacaggacttacaaggctcggctgcccctgaggctctttctcatcatcgccaacaccatggcattccagaacgatgtgtacgaatgggcccgggatcaccgcgcccaccacaagttctcagagacacacgccgaccctcacaactcccgccgtggctttttcttctctcacgtgggttggctgcttgtgcgcaaacacccggctgtcaaagagaagggcggaaagctggacatgtctgacctgaaagctgagaagctggtgatgttccagaggaggtattacaagcccggcctcctgctcatgtgcttcatcctgcccacgctggtgccctggtactgctggggtgagacgtttgtaaacagcctgtgcgtcagcactttcttacggtacgctgtggtgctcaacgccacctggctggtgaacagcgccgcccacctctatggatatcgcccctacgacaagaacatcagctctcgggagaacatcctggtgtcgatgggagctgtgggcgagggcttccacaactaccatcacgccttcccctatgactactctgccagtgagtaccgctggcacatcaacttcaccacgttcttcatcgactgcatggccctcctgggcctggcttatgaccggaagagggtgtccaaggccgctgtcttagccaggattaagagaactggggaggagagctgcaagagtggctgagttcggggtcttccagttcctgttccaagagccggcttggcagaggcttactgttctgttaattaactactgagtattgctacccagatgctaaaatgatgaagttaacccattctggtacagtattgtaaaacggacaaatatcggaagtcaacagctctaccttttgatgctaagctgttctccccttctatcttcttttcccgttgtctttttcttcgctttgtccccaatgacctcacccctcatcgcctcccctaagccagcagccactccgctgtagttcagagttcaccttccagagcgtaccagcttttcaagggtctacagtaaaggttcacgccccagccccaacttaacgttgctccaagttacagatagaagaaaaatcttgagaaatttctcctgttattttagtccagactttgccagatggaatgggagaaaaaatagttttatttggcagagagcttgcgaagtgggtaaatcttaaggggccaaattcaacactcgggctgtgattcatcaaaattgtgggagagggggatctcctgtgatcaggctccgctccgtctggccgaggtgctggcgtctcttgacacagcgtgcctcctctcctaattctgattgggtgacagccgtggaactttgtgacactaaaatatggcaacacatcggtatctcagtgtactttaggctaaagatttaaaaaaatagagaagtgaaaaacaatttgtaggaaaagtggtctttcctaaaataagattttcttttcctttcataacaaggacctggggccaggcgtcgtggcacccgcctcaaaacagttgagaggagaggggcaggtgggtctctgagtttgaagccagccagggctagatagtgaggccttgtctcaaatagaaaagccaacaattagcaggacacacggagccgggggtcctcttgcgaggcgtgtctggaatccatgagggcggtcgctcgtggtttttgagcttcctgtgagctgcacccccagacacttgtaattcctgttcttccgtctttcggatgcaggttgctcccacaaattcaggatagctatggcgtttccatgcatcccacaatggaaggagtgtaagacttgagcttgagtcacagctaaaacccagaagacacaaagtcagtctgtcctggatcctacaaacactcaacgagtgcctccctctggaaaagatggtgaacaccttccttccactgttgggcagtggacagggaagttggaggtcgctgtaggcagctccaaggtttctaggggcaccttgccaggggacctcacaactttggcggtctctagtggagcaggttaggttttagctccctttggttcccgctgtgctttgtggtaaggcttttccctgggctgttgcctcattcctcactagctctgtgaccaggtaggactctgggatacatggctgaaagctcttttgctctaccacatctgcctctctttccctacccatttttttgtgtttcggggtggtatttttgtggtggttgttttgttttatttcttctttcctctttgacgtttagtcttgctctaggcagaaacgtcctggatatttacggtcagtaaagatgtccggtcccagcagagatacaacctctatctgcagtaggtagagaaggctgtccctttccggtggctttcagattctccacctctatccctcccaggcctctgatattctttaaactttaaaggaaaagtttggccgactttctagaaacatccctggctcagagaggctctctgtctcctcggttgttctaaaacaaatggtccgggtggtgtgggtgctggcccaagactcgattcctctgagttagggcagagcatgctccctgcactcagcaaagcctctcgggctgatcagtgctcctgggtgatgctgtggtgcttttaggaggaagacagtgttggctggctggaaagcatgacagttaaggttgtgttcttaagtgcctcagtttgaaagctttggctagggtaggagatctgagatgccgtggactttgcagaagagattttgtgcagcaacgcagaagcctggctgtgttaagattggctgtacaggatagcgaatgctgtggttggagggcacagtcttcccgtgttagttaaatagagaggctttaggacgtctctgcgcccacttgaaggtagccttatcctttagctgttcgctaaaatagaatccttgagagattgacaatatatttgctggcctgtcgccctattccttggagaggccttttgaatggttttaattccactggttatccggtgcccacttaatcaaatgtgaaaaataaaaagcagctctcttcttagcctgcccccgtggatctgaggaccctgttagatacagctgtcggtaagggtgtaccagctcactaagaaacactactgtcaagattttaaagctcagaccaagtgacacgttaataagaaactaagatctgattgaattttctaacagtccttgcctcgtggacacgctaaaattcgacttgggtgccttacctcttttctaactagtgttactcatgggcctgcgctcccttcctctgcggattccttagaaccggagagcctgtaagtgtgacaggctcaaaactggcctggctggagggttaggtggactttgatctgcagtgttccctctggggtcttcgtttggggaatatttcttggggctgttttgctgaagtgcccgtagctgatggatggtggaagtaatttgaacgtacgcgatttgtaggttttgttatttgttttaagatttaaaggctggttgtagcatttaaaagtgaaagctttttcttcctggtttgctagtgttctgcgtgtcttctttagttgaaataggttagtggagaagttaagaaagcggtggccgtgttacgctggtggtgaaggccagggccgcctacaaactctcagttttgttttgttttgtttttttataacagtcccactctgacaataatgagttcactccttggataaggttgttaatgagggaagagcccttcagacctaatcagctcttactggacccagctgtcaacactgttgcattggggattaagtttccaaccccgtgaatcatgggacagactcaaaccgtagcactgggcatgtcgcctaacaatataatgtgactcagtattctgtgagacatgggataatattcctgacctacctccacgggtaggtgcgagcatgagcaaatgctctttataaaacatttggggatcctcagcagaggagtatttaagtcctgcacatttttatagtaaccgtccaccatggacttgacacgtgcctatgtcccagacgacattgttaatctacatcattcttctcagaggttgaatggatgcattagataatgtatactcattgctatggaaacctgcaggactccttttccttccttgggtgggatttttttttcctttattatgtgcaacagtagctatttgtaatctaataattttcattaataccaactctgaaagtatttctactcatctgaggttgtgtttgttcataataaaatgaaatggatctgactgc

SEQ ID NO: 2340 - DNA, 3513 bp, Rattus norvegicus
  Genbank Accession No. NM_031969
gtgcagccaccctcgcctgcctcgctcttccttccttcgctcgcaccatggctgatcagctgactgaagaacagattgctgaattcaaggaagctttctccctatttgataaagatggggacggcaccatcacaacaaaggagctggggactgtcatgcggtcactgggtcagaacccaacagaggctgaactgcaggatatgatcaacgaggtggatgccgacgggaatggcaccattgacttcccagagttcttgactatgatggctagaaaaatgaaagacacagatagcgaagaagaaatccgtgaggcattccgagtctttgacaaggatggcaatggctacatcagtgcggcagaactgcgccacgtcatgacaaacctcggggaaaagctaacagatgaagaagtagacgaaatgatcagagaagcagatattgatggagacggacaggtcaactatgaagaattcgtacagatgatgactgcaaaatgaagacctactttcaactactttccccctctagaagaatcaaattgaaatcttttacttacctcttacaaaaaaaaaaaagaaaaaagaaaaaagttcatttcttcattctgtttgtatctagcaaaactgaatgtcaaaagtaccttctgtccacacacaaaatctgcatgtattggttggtggtcctgccccctaaagatcaagccccctacatgagttttacagtataaatactcgtactaccttataaggaagcacttagtggactccttcaagttccatttgctaatgattaacacactgtctgggctggccagtttctcatgcatgcagcttggtgattgagcacagtcaggcctttgtattaaaactgaaaaatggaaaaaacaaattcaaactctcagatggcttctagttcaatctgttcagataaatgtcagcagccagtttaccgcaaacaaacatttaaaattggtttacctcaggatgatgtgcaggaaacgggtgaaggctaaactttgagacacagccctagatgtaggacagtcctcttcaagtgccccaatcccatggtgacagtgacaccctggtggcgagcccgagtgtgatggttcaccgctgtgcacattgcattggagtgaagtgaacaaggctgtcaccaaatcacacacgttttaataagaaatgtttactaagggagcatctttggactctctgttttaaaaccttgtgaaccatgactcggagccagcagagtaggctgtgtctgtggacttgagcacaccatcaacattgctgttcaggaaattataatttacgtccattccaagttgtaaatgctagtcttttattttttttttccaataaaaagaccattaacttaaaagtggtgttaaatggtttgtaaagctgagcttggaagggggacaaggccgttggaggggaggtcagcggacatagaaacacccaacgtccagtacaagctggatttcccgcccaggttctctagcatcaacccctgaaaccagacagattctttgtcatctacgaccatgtaagtctagttattcaaatctgcgcgcatgcgcaaatcatggtgaattgatacttggagtagagccctagtgaaggaaggcctcaagcattcagtaaggatgtcttggctgtgctgctgctgacctgttgaagtacatgaggccatctgtgcaggagacatgatttagtgtgtgtgtaatcctatactcactgtgtatggtgaagcaggccagtcaaagacactacctttgattcagtttaatttatggttatacttaactttagccttttttattatttaagttcactgctttttctccccctaagtagagttaatgcttaacactgtcttgaaagcaaaacaatatcccagaatgaattttgtgtcttaattacgaacctgtaaccaaaacgtacatgtgctggtactggtcccttagcccaaggcactgggctatttaaaaagtcccccttaagaagtgtgttgcatttaaaacaagggccttgtacatttttcagggtgttaactggctgtatctgattaataaggagtgttggcttccaaattcgggggtggcagggagctggcaggcttgtagcaaggcaatgagaagcccttggcaaccacacgggtgcactcggggtaacctacagacccctggttgctccttctcctgctccctgtctttctggcgttttgtagctccttagaattttttttctttctgccaggaggataggtcagagcagtagagaggaagacattgcctgagcgcttctgctcatctttggactgggtggttggcagacaggtcgatgggtggtaaattgacttcagtatcggactcagtaggtattcccttttggtagagaggactgagggctccaggtgtgaagtgaatggccgtggatatgttgtgtaagaggattaagtcgcccagtcgatgacccagtctcaggcttgtggtctgttacctcttggtagtttcaaagggggtcggaggtggctttttaaaaacaatttaccccctatctttaaccatttaccaagtctgtagaagctgggtagacaatattttagcagctccgtagcctgtcctaaaaggttaccttctaaacaggattcttgtgtggccagggatcctgcatgggaactggaaacccctaacccccggggggtgggaagcaggagtttggaactgtaggaggcagagtccccccacctcctcagccttctggcatccaggggcacaagcagcccagggcttggtgttggcagtctgagttcgtgaggtagaaagagtggggtgtcaaggcagtacccctgaagttggatagtactttcctgtaaactgtccctcacttataactactctataaatatatgcatatatttatataaatatatatatataagtgactggttagctggcatcctgctttagcctgagacttgccctaagaaactgctgagcccttggtaaacgtctacacagtaagtttttctgtctgttggggggagctgttgaacaaggcagacatcttgatagttcagatgggctttaatgtactgttgccagggaaggctttttctggttttttgacaaatttttagcacacttcaattggtgtctcgagcaactttaacacattgaagatgaggtattgtacatatttttatattctctttataagtgcatgtctccaacttgtaaccaatattgtacggaatggctgtccagtaggcctagtgtttctgtcacacgagagggatagcatgtaccattcacccctcagcatcctgggagcttcttcttgaatgaagactgtaaatttggtcaagtcaactcttagttcggtttccttaccatttgaatgattgactgtgtgtcctgcgtgtatttctcttttggcagcgaccagagttacactgatgtgtctcaaccgacccactcggctggcaaccacctatttattttct

SEQ ID NO: 2341 - DNA, 787 bp, Rattus norvegicus
  Genbank Accession No. NM_031970
gcacttctcggatcctcagcccagtgcttctagatcctcagccctgaccagctcagccaagaccatgaccgagcgccgcgtgcccttctcgctactgcggagccccagctgggagccgttccgggactggtaccctgcccacagccgcctcttcgatcaagctttcggggtgcctcggtttcccgatgagtggtctcagtggttcagctccgctggttggcccggctatgtgcgccctctgcccgccgcgaccgccgagggccccgcagcagtgaccctggcccggccgttcagccgggcgctcaaccggcaactcagcagcggtgtgtcagagatccgacagacggccgatcgctggcgcgtgtccctggacgtcaaccacttcgctcctgaggagctcacagtgaagaccaaggaaggcgtggtggagatcactggcaagcacgaagaaaggcaggatgaacatggctacatctctcggtgcttcacccggaaatacacgctccctccaggtgtggaccccaccttggtgtcctcttccctgtcccctgagggcacactcacggtggaggctccgctgcccaaagcagtcacacaatcagcggagatcaccattccggtcactttcgaggcccgtgcccaaattggaggcccagagtcggaacagtctggagccaagtagaagccttcagcttgctacccatccccagtagccgtcaccagccctccctctctgtcaatctgaatgctcttttgatacatgtactttctgttttactcaaataaa

SEQ ID NO: 2342 - DNA, 2455 bp, Rattus norvegicus
  Genbank Accession No. NM_031971
agagaagcagagaagcagagcaagcggcgcgttcccgaacctcgggcaagaccagcctctcccagagcatccccaccgcgaacgcacccttctccagagcataccccagcggaggccacccttccccagagcatccccgccgccaagcgcaaccttccagaagcagaccgcagcgacatggccaagaaaacagcgatcggcatcgacctgggcaccacctactcgtgcgtgggcgtgttccagcacggcaaggtggagatcatcgccaacgaccagggcaaccgcacgacccccagctacgtggccttcaccgacaccgagcggctcatcggggacgccgccaagaaccaggtggcgctgaacccgcagaacaccgtgttcgacgcgaagcggctgatcggccgcaagttcggcgacccggtggtgcagtcggacatgaagcactggcccttccaggtggtgaacgacggcgacaagcccaaggtgcaggtgaactacaagggcgagaaccggtcgttctacccggaggagatctcgtccatggtgctgaccaagatgaaggagatcgccgaggcgtacctgggccacccggtgaccaacgcggtgatcaccgtgcccgcctacttcaacgactcgcagcggcaggccaccaaggacgcgggcgtgatcgcgggtctgaacgtgctgcggatcatcaacgagcccacggcggccgccatcgcctatgggctggaccggaccggcaagggcgagcgcaacgtgctcatcttcgacctggggggcggcacgttcgacgtgtccatcctgacgatcgacgacggcatcttcgaggtgaaggccacggcgggcgacaccgacctgggcggggaggacttcgacaaccggctggtgagccacttcgtggaggagttcaagaggaagcacaagaaggacatcagccagaacaagcgcgcggtgcggcgcctgcgcacggcgtgcgagagggccaagaggacgctgtcgtccagcacccaggccagcctggagatcgactctctgttcgagggcatcgacttctacacgtccatcacgcgggcgcggttcgaggagctgtgctcggacctgttccgcggcacgctggagcccgtggagaaggccctgcgcgacgccaagctggacaaggcgcagatccacgacctggtgctggtgggcggctcgacgcgcatccccaaggtgcagaagctgctgcaggacttcttcaacgggcgcgacctgaacaagagcatcaatccggacgaggcggtggcctacggggcggcggtgcaggcggccatcctgatgggggacaagtcggagaacgtgcaggacctgctgctgctggacgtggcgccgctgtcgctgggtctggagaccgcgggcggcgtgatgacggcgctcatcaagcgcaactccaccatccccaccaagcagacgcagaccttcaccacctactcggacaaccagcccggggtgctgatccaggtgtacgagggcgagagggccatgacgcgcgacaacaacctgctggggcgcttcgagttgagcggcatcccgccggctcccaggggcgtgccccagatcgaggtgaccttcgacatcgacgccaacggcatcctgaacgtcacggccacggacaagagcaccggcaaggccaacaagatcaccatcaccaacgacaagggccgcctgagcaaggaggagatcgagcgcatggtgcaggaggccgagcgctacaaggcggaggacgaggtgcagcgcgagagggtggctgccaagaatgcgctcgagtcctacgccttcaatatgaagagcgccgtggaggacgagggtctcaagggcaagatcagcgaggctgacaagaagaaggtgctggacaagtgccaggaggtcatctcctggctggactctaacacgctggctgagaaagaggagttcgtgcacaagcgggaggagctggagcgggtgtgcaacccgatcatcagcgggctgtatcagggtgcgggtgctcccggggctgggggcttcggggcccaggcgcccaagggaggctctgggtcggggcccaccatcgaggaggtggattagaggcttttctggctctcagggtgttggctagagacagactcttgatggctgctggtgcacgattcttatcaagttactccttctctccggagttcagtttaaagttacagccttttatacggtaattgatttgagtttgttacattttgtatgctcgtgggttttttatatattcaaattaaggttgcatgttctttgcgtttaatctaagtagctgtgtaaaaatggtgtttccttcctgcgaacacctcagcactgccaccctgtgtacagttttttccttgcatccctacaaactgagaaaaaaagttatcttttgtaacttaaacattcaaaataaaatgttacaagt

SEQ ID NO: 2343 - DNA, 1725 bp, Rattus norvegicus
  Genbank Accession No. NM_031972
gaattcctgctgcacccatatttgaatattgttttatcctcatcacgcgaacttcctggggaaggactccaaggtccaagtgggcgggaaggagggtccttaaatgtgccctctttcagctcttgctcattccaggagtcccagctgctggagaaggctgtgtaggagttgcaatgagcagtatcagtgacaccgtgaaacgggccagggaggcctttaactccggcaagactcgatcgctgcagttccgaatccagcagttggaggcgctgcagcgcatgatcaatgagaacctgaaaagcatctctggggcgctggcctctgacctgggcaagaacgaatggacctcctactatgaggaagtggctcacgtactggaggagcttgataccacaattaaggagctccctgattgggctgaggatgagcctgtggccaagactcgccagacccagcaggatgacctctacatccactcggagcccctgggtgtggtccttgtcataggtgcttggaactaccccttcaacctcaccatccagcccatggtgggtgccgttgctgcaggaaacgcagtgatcctcaagccctcagaagtgagcgggcacatggcagacctgctagcgacactcatccctcagtatatggaccagaatctgtacctagtggtcaaagggggtgtccctgaaaccacggagctgctcaaagagaggtttgaccacatcatgtacactgggagcacagccgtagggaagattgttatggccgctgccgccaagcatctgactcctgtcaccctggagcttggagggaaaagcccttgttacgtggacaaggactgtgatctagatgtggcttgcaggcgtatcgcctgggggaaatttatgaacagtggccagacctgtgtggccccagactacatcctctgtgacccctcgattcagaaccaaatcgtggagaagctcaagaagtcactcaaagatttctatggggaagatgctaagcagtcccgtgattatgggaggatcatcaatgaccgtcacttccagcgggtcaaaggcctgattgacaaccagaaagtagcccatggaggcacttgggaccagtcctcacgatacatagctccaaccatcctggtggatgtggacccccagtccccagtgatgcaggaggagatctttgggccggtgatgcccattgtgtgtgttcgaagcttggaggaggccattcaatttatcaaccagcgtgagaagcccctggcactctatgtgttctccaacaatgagaaggtgatcaagaaaatgatcgcagagacatccagcggtggagtgacagccaatgacgtcattgttcacatcaccgtgcccactttgccctttggtggtgtggggaacagcggcatgggggcctaccatggcaagaaaagcttcgagaccttctcccaccgccgctcttgcctggtgaagtctctgttgaatgaagaagctcacaaggccaggtatcccccaagcccagccaagatgccccggcactgagagagtgctgctgcacctgacacatgttttgctggctgtcttgtccttgaggagttgctcatggagcctcatcctggcttattcccacctgccgtcctgtgcttaactccccgaaggactctcacctcactcctccaaattccactgtttgctgggcacagaaatcaataaaagcctctgaggaaaagtc

SEQ ID NO: 2344 - DNA, 1124 bp, Rattus norvegicus
  Genbank Accession No. NM_031974
tctccgctcgtcctccggtagcagccgccagcacagtgtccgctgctgggcggggtgtcggcggatcggtcggttggtttcggcttcggtgtcgctgcgtttgagttgggccgtcatggctgagttggatccatttggcgctcccgccggtgcgcccggtggccccgcgctcgggaacggggtggcgggcgccggcgaggaagacccggccgcggccttcttggcgcagcaggagagtgagattgcgggcatagagaacgacgaggccttcgccatcctagacggcggcgcccccgggccgcaggcacacggcgagccgccggggggtcctgatgcggttgatggagtgatgaatggcgaatactaccaggagagcaatggtccaacagacagttacgcagccatttcagaagtggatcggttgcagtcagagcctgaaagtatccgtaagtggagagaagagcagacagagcgcctggaagccctcgatgccaattctcggaagcaggaagcagagtggaaagaaaaggcagtgaaggagctggaagagtggtacgcaaggcaggatgagcagctacagaagacaaaagccagcaacagggtggcagatgaagctttctacaaacaacccttcgctgacgtgattggttatgtcacaaacataaaccatccttgctacagcctagaacaggcagcagaagaagcctttgtaaacgacattgacgagtcatccccaggcactgagtgggagcgggtggcccgcctgtgtgactttaaccccaagtccagcaaacaggccaaagatgtctctcgcatgcgctcagtcctcatctccctgaagcaggcgcccctggtgcattgaagagccaccctgtggaaacactacgtctccgatcttaatcctactcagtgaagctgttcacgcaattggattaattatgccgagttcttttggaccaaaccttttgtctttagagttgatcattgtttgtgattgcatgtttccttcaactgtgttctccctggcattcagagaagagagaggaagaggaagggaggggagctcccaacagtagcctcaacctgtgcttttgtgcattattctgagaataaatttctgtttc

SEQ ID NO: 2345 - DNA, 936 bp, Rattus norvegicus
  Genbank Accession No. NM_031975
gaattccggccgccgccaccgcgccaagttccggccgcggccaccttccgccgtccagggctcctccgcctcggccccgggaccccggctccccgccagccccggccccggcaccatgtcggagaagagcgtggaggcagcggccgagctaagcgccaaggacctgaaggaaaagaaggacaaggtggaggagaaggctggccggaaagaacggaagaaagaagtagtggaggaggaggagaatggagctgaggaggaggaagaagaaactgctgaggatggagaggatgatgatgaaggagacgaagaagatgaggaggaagaggaggaggaggatgaaggccccgtgcggaagagaactgctgaagaggaggatgaagcggatcccaagaggcagaagacagaaaacggggcgtcggcttgagcccctgcccgtgggcttggggatgggaggcccctcaggtcctggaggtggggcaggaacacacaaatccagccccccttctcctggctccctcgtctggccctgccccagagctgtgacccttgccctttgacccagcctctcatttccatctctccagacactgctccttcaccctcactgccacaggtccagcccccaacccgcctcatccaagctccccagccggccctcacttgccctagcattccttgttcttccctgccttcctcaccatcgatctgttccagtccttgcgaagcctctccttcccctctgcaccccgagcctctcagcctgcccttctctctcctgcctgacccctgggtctccctcagattccctcctctcagacagcgccaggccggggtggggctggggttggggccaagccccgaagctgccccctcccctttttgtataatttaataaagaaacggtcgcgcttcaaaaaaaaaaaaaaaacggaattc

SEQ ID NO: 2346 - DNA, 1978 bp, Rattus norvegicus
  Genbank Accession No. NM_031976
  misc_feature (1)..(1978): n = a or c or g or t
ctcgctgcggtccaagcaggtaaagcggggctcggcgaacgcgcgcgacccgaggggcgtggtccgcggtcccgggggtcccggcccggcccttcccgcttccctgtgtccccgcagacacttcgccatgggcaatacgagcagcgagcgcgccgcgctggagcggcaggctggccataagacgccgcggagggacagctcggagggcaccaaggatggggacaggcccaagatcctgatggacagccccgaagacgccgacatcttccacaccgaggaaatgaaggctccagagaaggaggagttcctggcgtggcagcacgacctcgaggtgaatgagaaagcccccgcccaggctcggcccaccgtatttcgatggacagggggtggaaaggaggtctacttgtctggatccttcaacaactggagcaaattgcccctcactagaagccaaaacaacttcgtagccatcctggacctnccggaaggagagcatcagtacaagttctttgtggatggccagtggacccacgatccttccgagccaatagtaaccagccagcttggcacagttaacaacatcattcaagtgaagaaaactgactttgaagtatttgatgctttaatggtggattcccaaaagtgctccgatgtatctgagctgtccagttcccccccaggaccctaccaccaggagccttacatctctaaaccagaggagcggttcaaggccccgcccatcctcccgcctcacctgctgcaggtcatcttgaacaaggacacgggcatctcttgtgatccagcgctgcttccggagcccaaccacgtcatgctgaaccacctctatgcactctctatcaaggatggagtgatggtgctcagtgcgacccatcggtacaagaaaaagtacgtcaccaccctcctctacaagcccatatgagaggatgagccagccgtgggccacgggacagcaggcgggagccgctgggctctccgtgtgcatgcgcatcctcactccgggacatctcacccccacatagtcctccttgaaggtctgtccaggcacagccagaaatcggatggacggcagaccgtggtcccagcaccgcaggcagtgcgccaggctctagtgctctaagcatcatccctctgctggcccgagatgtctacagccagacctgaatgctggttcctgctagaaaacctaggacaggaactgaagtcaccaaagccctcatcatccctgctgaagcctggcttggaagaaagcagtgctcggtcttgcctgtccttccgaatcacagcagtagattgtagactccatggaatttcagtgtccaatttccagatgcagcttcgcaatcgattcctgacactgtgcactgagaccttcttaaccagagtggctggctgtccactctcacttaaggcaataagtcaccaggacgagactataggtcatgtgactactgagcaataatcgttctcanacagacatcagaaaccactgccatttctccatcaagccagacgatcctgaggactgaccaccatgggaggttgtccaccttatttcagttgcagtgttggccatgttaccgtgacaacctggtcgaagtgcccgccctctttttagttctagcacgtgctactcagctgggggccgtgtctccagtgagcagagagtgtacacggtggttactattgcctgatcctaagagagcttggcaccctgcggcagactgctaggttccagcagggttggcacgagtgaacctatgtgtgctcagtgtgatttccacagtgatgtcacagacgtgcccattggtacaggctcctgtcacctgtcagcataggtaggcacaagctctgtggtgtccgctatttggttaaacctgagttttgggtaccttttgttactgttttcaaaacacggacttgctgtcatcttgatgtacaagtttcaataaagctttgg

SEQ ID NO: 2347 - DNA, 2280 bp, Rattus norvegicus
  Genbank Accession No. NM_031984
tgtaaatacagggctgaaagtgggagtggcgctccctcttcctgttatccccttggctcagcctcactgcctgatagaaatgtttctaatatggcacctggtcacagtccattgtagctgaactcccaggtcctgcactgtacaaccctcaccttcccagttcccttaccacctaataaagggcctgcctccggacagcgcccggcccgccgcgcccagctcagcctgctcagccctctggtcccgaggttccgctcagcgctctctcaaactagccgctgcaccatggcagaatcccacctgcagtcatctctgatcacagcctcacagttttttgagatctggcttcatttcgacgctgatggaagtggttacctggaaggaaaggagctgcagaacttgatccaggagcttctgcaggcacgaaagaaggctggattggagctatcacctgagatgaaaacctttgtggatcaatatgggcagagagatgatgggaaaataggaattgtagagttggcccatgtcttacccaccgaagagaatttcctgctgctctttcgatgccagcaactgaagtcctgcgaggaattcatgaagacttggagaaagtatgacactgaccacagtggcttcatagaaacggaggaacttaagaactttcttaaggacctgctagagaaagcaaacaagaccgtggatgatacgaaacttgctgagtacacagacctcatgctgaagctgttcgactcaaataatgatgggaagctggagctgacagagatggccaggttactaccagtgcaggaaaatttccttcttaaattccagggaatcaaaatgtgtgggaaagagttcaataaggcttttgagttatatgatcaggatggcaacggatacatagatgaaaatgagctggatgccttactgaaagacctgtgtgagaaaaacaaacaggaattggatattaacaatatttctacatacaagaagaacataatggccttgtcggatggagggaagctgtaccgaacagatcttgcccttattctctctgctggggacaactagagttggtggccacaaccacttgctagtgatacattgtatctaaaaccataactgtgcgctataaaggagtaggctgtattttcttttatatctgtaaattctactgcatatagagaattatccaggatgtgtggcacattcttttctgcttgtttctatactgtttgtaatgtacagtttttgtaagcatataattgaaaagaagaaagtctatgcttaggccagtcagtataatccattttcaaagatgaatctaacatgattctgctttcataaatacagatgaacacttggatttccctaaaactctaccatctcaacaattctagtgtcagatgtgtaaatgcacagctgtcagtgagtaaaagaataattcatgacaagccaagtgttttttaatttaggcaatcatagaactgtcccacaaagcacttctgtgcgttttccatctagtggaagggatgtgcttctgcttgtgaagcaccaaatgtcaatagttaactatggctttatcataaaacgatctccctagagatttaatttactgatcagtggcatgtctactgcttgaatagataccacactgttggttcaagctggcttggtggcaagggaaggtagccagatgacacataaatctgtctgatactatgcctatatttccaagaagtctattgcagagagtatgaccttagcccattttctaaattattttcatgtgttccagatgacaattattctagtaaactgctgttttgtgtcatattctgtgtgtactctctgattaaattcaatgtacctctgaggcctgtcgcagttgggctccggctcctttgcggagcaccatgtcgcagagggggaggagaccctgcagggcgcctgggtagaactgcacttcagcaatgggaatgggagcagcgttccagcttccgtctctatttataatggtgacatggaaaaaatactgctggatgcgcagatgaatctggacgaagcatctccaagagctctcactgtgacagcccacctcgctcccagacaccacaagataccaacaagagctgaaatagcaccacacgtttggtgagaaaaaacagcatgtgtgtctgaggaagattatattgagagaagaagagaagttgaaagtatcctgaagaaaactcagattggatatgggattggtcaagtcggccagaaaatgttcccccc

SEQ ID NO: 2348 - DNA, 2287 bp, Rattus norvegicus
  Genbank Accession No. NM_031985
gtctgcggcgggtccgggcccatgaggcgacgacggaggcgggacggcttttacccagcgcctgacttccgacacagggaagctgaggacatggcaggagtgtttgacatagacctggaccagccagaggatgcaggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaagatatttgccatgaaggtgcttaaaaaggcaatgatagtaagaaatgctaaagatacagctcatacaaaagcagagcggaatattctggaggaagtaaagcatcccttcattgtggatttaatttatgcctttcagaccggtggaaaactctacctcatccttgagtatctcagtggaggagaactatttatgcagttagaaagagaggggatattcatggaagatacagcttgcttttacttggctgaaatctccatggctttggggcatttacatcaaaaggggattatctacagagacctgaagccggagaacatcatgcttaatcaccaaggtcacgtgaagctgacagactttggactatgcaaagaatctattcatgatggaacagtcacgcacacattttgtggaacaatagaatacatggcccctgaaatcttgatgagaagcggccacaaccgtgctgtggattggtggagtctgggagcattaatgtatgacatgctgactggagcacctccattcactggggagaatagaaagaagacaattgacaaaatcctcaaatgtaaacttaatttgcctccctacctcacacaagaagctcgagatctgcttaaaaagctgctgaagagaaatgctgcttctcgtcttggagctggccctggggatgctggagaagtccaagcgcatccattttttagacacattaactgggaagagcttttggctcggaaggtggagcgcccctttaagcctctgttgcaatctgaagaggatgtgagtcagtttgattcaaagtttactcgtcagacacctgttgacagccccgatgactcaactctcagtgaaagtgccaaccaggtctttctgggttttacatatgtggctccatctgtacttgaaagtgtgaaagaaaagttttcttttgaaccaaaaatccgatcgcctcgaagatttattggtagcccacgaacgcctgtcagcccagtcaaattctctcctggggatttctggggacgaggtgcttcagccagcacagcaaatcctcagacacctgtggaatacccaatggaaacaagtggaatagagcagatggatgtgacaacgagcggggaagcttcagcgccacttccaatccgacagcccaactctgggccatacaaaaaacaagcttttcctatgatctccaaacggccagagcacctgcgtatgaatctatgatgaaacaatgcttttattaatgcaaatgcaaaaaggaaacaaatcctggaagggcatgtgtgaggatcctgcaagataaaaatgagaaaatggcagtctcaaagagtcagtgtcattacctggaatgctttcgatggaggaaaaaataaacatggatttttaaaaaaatcaatcaatggtgcaaaaaataaacccacaaaaaactcaaacaaaatagtattgtggaacccacagacacatcaactgactggttcctaccctagcaacatctcagcgttcgtaaggattctcatgctgatggccgtaaactgacagtattaagggtaggatgttgcttctgaatcactggtaaagtctgatgatgtcacataagggttatcctaataggcaaagtacaagattgcctgtaatacttgcaactaaggacaaattagcatgcaagctttgtcaaactttttccagcaacacagaatcaaagacaaaagaaacttatcgattgatgttttacgtgcaaacaacctgaatcttttttttatataaatatatatttttcaaatagatttttgattcagctcattatgaaaaacatcccaaactttaaaatgcgaagttattggttggtgtgaagaaagccagcttctgttcttctcttgatgaaataaaatgcaaatggatcattgttaaaaaa

SEQ ID NO: 2349 - DNA, 2077 bp, Rattus norvegicus
  Genbank Accession No. NM_031986
gacccacgcgtccgggagccggagcgagcggcaggaacaacgcggtgttcggggcagaaaacacctgcaaaaatgtctctctatccatctcttgaagatttgaaggtagacaaagtaattcaggctcaaactgcctcttctgctaatcctgccagccaggccttttttttaaatgtggtcgattctgctgccttccctccaggtggaaatctctatcctaaactgtatccagaactctctcaatacatgggactgtctttaagtgaagctgaaatatgtgaaaacatgcctgtggtctctggagcgccaacccaagggcagttggtagcaaggccatccagtgtgaactacatggtagcacctgtgacaggtaacgatgcggggattaggagagcagagattaagcaagggattcgggaagtcattttgtgtaaggatcaagatggaaaaattgggctcagactgaagtcagtagataatggtatatttgttcaactagtccaggctaattccccagcctccttggttgggctgcgatttggggaccaggtgctccagatcaatggtgaaaactgtgccggctggagctccgataaggcacacaaggtgctcaagcaggcctttggagagaagattaccatgaccattcgtgatagaccctttgaacggacagttaccatgcataaggacagcagtggacatgttggctttatctttaaaagtggaaaaatcacatccatagtgaaagacagttctgctgccagaaacggccttctcactgatcaccacatctgtgagatcaacggacagaacgtcattggcttgaaggatgctcagattgcagatatactgtcaacagctgggactgtggtcaccatcacaatcatgcctgcctttatcttcgaacatattattaaacggatggctcccagcattatgaaaagcctgatggatcacaccattcctgaagtttaaaccttgtacagtgcatcaccgccgaacgcttccagtcttcctcttcggcaacttctctatttcaccgcacatgaagctttcccggatccagggagactgtgctgcatggagacctgtctatcttccaccatggctgggaacctcactctatctgagagcgtcttcagattttaagataggtgtagccttatcctggttttacagatgtgaactctcaaaagattccctgactttctagacttggttctttactgggaacctgatgtttttctataagccattgtgattaggatgactggtgtaggcttagctgtgtccgagaactggtctgctttctccgagaagtgcacagtgctaggcacgtgcttcagttctgtggcatatgtggagtgtagtacatcagcatagtacctgtaggatgagtgcctttgatcgcaactttttaagtgtgtgtgtgagtgtgtaaaattccagttaatcaacacttcattcacaaaagcattatacagttctgtgtaggtggcaagagactaatgattgtcactaaattctaacaccttcacctaatgtgcttcagttgtcgcctaacacagaagcatttagataaagcaaatagaaattattgctgccttctgaaacctgagaggtagctctctatcaagctgttctatgctagccctgagcagcttactggtgtcgcagagctgcctagctgtaccaagattttctagtcactgcataaaggaaacgcctaagagttgccgtattgctttctgagatacaaattgctatatatttcatgtaaaagttgttatactaaataggataaattttggagtctcttttcactcgtagataaagtgggtaatatctaatttggcacttgagtcctaacattatgtaactttagctaggttggggtgggtttagaatgtttccctagtcatctcagtttgttccattttctgactctatcctgcaaacaaaaatggcaatgacactttatcctgactctttccttcttagtttgtgcctatcttattattttatgtgatattatcctattaaatgtataaaaatattaaaaaaaaaaaaaaaaaaa

SEQ ID NO: 2350 - DNA, 2681 bp, Rattus norvegicus
  Genbank Accession No. NM_031987
gagtgcagagagccaagccgggtgcaggagttttcttactgtgactataccatggaaaatcaattggctaagtcaattgaagaacgaacattccagtaccaggactctcttccgcccttgcccgttccttcgcttgaagaatcactgaagaagtaccttgagtcagtgaagccatttgcaaatgaagacgaatacaagaaaactgaagaaatagttcaaaagtttcaagatggagttggcaagacattgcatcagaagttacttgaaagggctaaaggaaaaagaaactggctggaagagtggtggctcaatgtcgcctacttggatgtgcgtattccatcacaactgaacgtgaactttgtgggtccgtctccccactttgaacactactggcctgcaagggaaggcactcagttggaaagaggaagcatactactgtggcacaacttgaactactggcagctgctaagaagagaaaaattgcctgtacataaatctggaaatactcctctagacatgaaccaattccggatgctgttttctacctgcaaggttccgggaatcactagagattcgattatgaattattttaagactgagagcgaggggcattgtccgacccacattgccgtgctgtgtcgaggcagagcgtttgtcttcgatgtcctccatgacggttgtttgatcaccccaccagaacttctcagacaactgacatacatctaccagaaatgctggaatgaacctgttgggcccagtatagcggcattaaccagtgaggagcgaactcggtgggcgaaggcaagagaatatctgattggtcttgatccagagaacttgactttattagaaaaaattcaatccagtttatttgtgtattccatagaagacaccagtccacatgcaaccccagaaaatttttctcaggtctttgaaatgcttcttggtggagatccagcagtgcgctggggtgacaagtcctataatctgatttcctttgctaacggaatatttggctgtagctgtgatcatgctccttatgatgcaatgcttatggtgaacattgctcactatgttgatgagaagctcctagagacggaagggagatggaagggttcagaaaaagtccgggatataccgttgccagaggagctggctttcactgtggatgagaagatactgaatgacgtctaccaagccaaagcccaacacctcaaagcagcatctgatttacagatagcagcatctaccttcacatcttttggcaaaaagctcactaagaaggaggcccttcaccctgacacctttattcagctcgctcttcagctcgcctactacagacttcatggacgccccggttgctgctatgaaacagctatgacaagatacttttaccatggccgaacagagactgtgcgatcttgtacagtggaggccgtcaggtggtgccagtccatgcaggatccttctgccagtctccttgaacgtcagcaaaagatgttagacgcttttgcaaagcataacaagatgatgagagattgttcccatggaaaaggatttgaccgtcaccttttaggccttttgctcatagcaaaagaggaaggcctccctgttccagaactgtttgaggatccacttttctccagaagtggaggaggtgggaattttgtgctgtcaacaagtctggttggttacttacgaattcagggagtcgtggttcccatggtacataatggatacggctttttctaccacatcagagatgacaggtttgtggtgacatgttcatcctggaggtcatgtcttgagactgatgcagaaaagttagtggagatgatttttcatgctttccacgatatgatacatctgatgaacacggctcatctttagagactcagagacatacaggtcacagaaactgggtacggagaatgggatggtgatacgacatggaaggaatgttgacttaaaggaaacctgttaatgcagggattagagagggatgcactctagatttattctaccttaaagccttctgttgcaacagcaatgcaaactcagacatagtgaatagaactatgcaatgttttaagcctcaacaatgcacatctgtatattttaacaatacaaatcctactctaatgttaaaatatttttgttggcacatgtgtaggttgcaagtcctctgtgaacataattatagagtatttctcaagcactttaatactttctaatggccagagggtataaaacccatggttagatgctaatttccctgacatcagtgccttctacatccagcacaggagtacaagcctatgagatttcatgggaaaaccactattgttcaatattgatctaaaatagctcctttgaacagacaaaagtatcaagttgtattagaaaagaatattagcaaaactcattatgatatgttgtaattaattttgtgaatataaaatcaaaacacttccatttaaatctacttggtagagttagtggctttaaagggttaaatgtcgagtatgattctcagaactttataattatttcccactgttattcaaaatgttagcatatagacattctcccattgtaattcagtgtttatattctcaaagaataaagcatccagaatccttgtaatttctcatttattttcaataaaaatgattcctgat

SEQ ID NO: 2351 - DNA, 3622 bp, Rattus norvegicus
  Genbank Accession No. NM_032067
cagcgtgagtgcgaggcggaggcggcggctgcagcggagcggacggtcgctcggcggcaggcactggtgtaatggataggtaacagaagaccacttcccttcctcctcagggcttcagcatgactgagtgcttcctgccccccaccagcagccctagtgaacaccgcagggccgagcacggcagcgggctgacccggacccccagctccgaggagatcagccctacaaaatttcctggattgtaccggacgggtgagccttcacctccccatgacatcctccacgagcctcctgatatcgtgtcagatgatgagaaagaccatggaaagaaaaaaggaaaatttaagaaaaaggagaaaaggactgaaggctacgctgccttccaggaagacagctctggagatgaggctgaaagtccttccaagatgaagaggtccaagggcatccatgtgttcaaaaagcccagcttctctaaaaagaaggaaaaggattttaaaatcaaagaaaagcccaaagaagaaaagcacaaagaagaaaagcataaagaggaaaagcataaagaaaagaaatgtaaagacttgacggccgccgatgttgttaaacagtggaaggaaaagaagaaaaagaagaagccaactcaggagccagaggtgcctcagacggacgccccgagtctcagacccattttcggcgctcccttggctgacgcagtagagaggaccatgatgtacgacggcatccggctgccagctgtcttccgggagtgcgtggactacatggagaagcacggcatgaaatgtgaaggcatctaccgagtgtcaggaatcaaatcaaaggtagatgagctgaaagcagcctatgaccgagaggagtctccaaacttggaagaatatgaacctaacactgtagccagcttgctgaagcagtatctgcgagaccttcccgagaatttgcttaccaaagagcttatgccccgatttgaagaggcttgtgggaggaccacagaggtggagaaagtgcaggagttccagcgcttgctcagggaactgccggagtacaaccatcttctgctctcctggctcattgtgcacatggaccacgtcatcgcgaaggagctggaaaccaagatgaacatccagaacatctccatagtgctgagcccaaccgtccagatcagcaaccgggtcctgtatgtgcttttcacacacgtgcaagagctctttggcaccgtggtcctgaagcaagtaacgagacctctgcgttggtccaacatggccacaatgcctacactgccagagacccaagcaggcatcaaggaagaaatcaggagacaggagttccttttgaactgtttacatcgagatctgcagggcgggataaaggacttgtctaaagaagaaagattatgggaagtacagaggattctgactgccctcaagagaaagctgagggaagctaaaagacaagagtgtgagaccaagattgcacaggagatagccagcctttcgaaggaggatgtttccaaagaagaaacgaacgaaaacgaggaggtcataaatatcctccttgcccaggagaatgagatcctgactgagcaggaggagctcctggccatggagcagtttctgcgtcgtcagatcgcctcggagaaagaagagattgaccccctccgagctgagattgcggagatccagagtcgccagcatggccgcagcgagacagaggagtactcctctgacagcgagagcgagagcgaggatgaggaggagctgcagatcattctggaagacttacagaggcagaatgaagagttagaaataaagaacaatcacttgaaccaggcagtccatgaagagcgggaggccatcgttgagctccgagtgcagctccggctgctccagatgctgcgagccaagtctgagcagcagctccaggaggaggaggagcccgagaggcgagggggcacaggcccactaccctgtgaaggtgtcctcgaggtgagagcagccaaggagcaggcgaagcctcgcccagcaaagaccggaaggagacgcccatctgaactgccccggccctgtgcatcgtactgtaagcgagagtccgctgcctgtcctgccaggcagcgttctgtgaaggctctcagagacgctcgctcttgcacacgtctgactccgtgtcaggctcaggtcctgggagagtgaaggggtggacactcgggggtggggggcttgcagggaacacaggtatttccagatagtgtcagcttatttgaaaattaattttctttgttaaaaataactattttaacccttgagtggcttctttttaaaccaaaaaactttttgcttttttttgttgttgtttaaatcacagcagaatcaggatctctttcttatcaaagggtgggaaccaaaccaggtcacttctgcgcctgccttgtggacgctcgtggtctcaccagccctgcagggtccctggccactcttgcttgtgccttccacaccttttggtgcagattgttcagtggggagctgcctcatattctctgactggccaaaaaggctctcgctggggttccctgtacctgccctgtgtgtaccactttgcttttccagctccgggtctgtcagtgtgagtcaggacggcccagtttggttgcagacggaggttaccatgcagcctgccaccagcctgggcagggcaggccacccactcactgccagggagcagcaagggcctcttctcagaggtggtcagagatgaccaccttgaccctgaggttgcacaggacacttctcacaccagggtccttttccacactgaccttccaggaaagtcaccttccacagtgacttcagttgctagcttgggctgggatacccacacctctgccaggataagccatgtagatgctgtcatgcacaactttcacctgtccatgtcatctcaaggggctgcttaaggactctgacagaactgagcggaaggaaggaaagcgtaactgtaattgaccccccctggtgtttgcctctaacctggacgactgctcccagcggtctgggaggccggactcttaggcaaccggatttcactgtcagatgagtggcccccagggaggtccccctgtggctctgaagacaaatcccacactctaaagtgagcgacaaacccacaggagggctccggtctactcctagttagtatttatttcagcacctgttggtgcgatttttcgttagcctctacctattgcactgttgtgacttgttggccattatttgatttttgtacggaaaaaaaagctttgttatagaaatcagcatactatttttttaaatctggagagaagatattatggaaactggaaacgtggtcaggtgtcaaatgtaaatgtataaatgccttgctgcacccgtcagatgtgcaacactcattctatatttgctggcaatattgaggaattctttttgtttgtgtaaactctaatttctatcaaggtatcatgggtttttaaaatttcattacaaatgtctcaatgttggttaactaatttttgccaggaccattattgattaaggaaataaactcagcagccatttgagaaaaaaaaaaaaaaaaaaaa

SEQ ID NO: 2352 - DNA, 5033 bp, Rattus norvegicus
  Genbank Accession No. NM_032071
cacgaggcgccctcgggcaggaccccgccccggctcccctgtgctcccggcgcccatggcgctgagcaaagggctgcgactgctggcgcggctggaccccaccggcccgagcagcgtgctgctggaggcgcggggccgcggcgactgtctactctttgaggccggcgcggtggccacgctggctccggaagagaaggaagtcattaaaggactgtatgggaagccgacggatgcctatggctgcctcggggagctgagtttaaaatccggtggcgtccccttgagctttctggtgttggtgacaggctgcacgtcagtgggcagaattccagatgcagagatctacaaaatcactggcactgagttttaccccctgcaggaagaggccaaggaagaggaccgcctgccagccttgaagaaaatcctgagttcaggggtgttctatttcgcatggcccaatgatggcgcctgcttcgatctgaccatcagggctcagaaacagggtgatgactgctctgaatgggggacctccttcttctggaaccagctattgcatgtgcctctgcggcagcaccaggtgaactgtcatgactggttgctgaaagtcatctgtggggtggtgaccatccgcacggtttatgcctcccacaagcaggccaaggcctgtctcatctctcgcatcagctgtgaacgcgcaggtgctcgcttcctcacccggggtgtgaacgacgatggccacgtgtccaactttgtggagacagagcaggcgatttacatggatgatggagtgtcgtcctttgtccagatccgaggctccgttccgctgttctgggagcagccagggctccaggttggctcccatcatctgagactgcacagaggcctagaggccaacgcccctgcttttgaaaggcacatggtgcttctgaaggagcagtacgggcagcaggtggtggtgaacctgctgggaagcagaggcggtgaggaggtgctcaacagagccttcaagaagttgctctgggcttcttgccacgcaggcgacacgcctatgataaattttgacttccatcagtttgccaaaggtaggaagctagagaaattggagaacctgttgagacctcagttaaaactacactgggatgactttggcgtatttgcgaagggcgagaatgtaagtccacggtttcagaaaggcactctgcggatgaactgtctcgactgtctggacagaaccaacactgtacagtgcttcattgctcttgaggtgcttcatctgcagcttgagagcctagggctgaattccaagcccatcactgaccgcttcgtggagtccttcaaagccatgtggtctctgaatgggcatggcctgagcaaggtgttcacagggagcagggccctggaaggaaaggccaaggtggggaagctgaaggatggggctagatccatgtctcgtaccatccagtccaacttcttcgacggggtgaagcaggaggccatcaagctactgctagttggagatgtctacaatgaagagtctacagacaaaggcaggatgctgctggacaacacggcccttctgggtttggggtcaaataaacaaaacagtctttcaggcatgctggatggaaaagcaacacccaggatcctgaaggccatgacagaacgccagtcagaattcacaaatttcaagcggatccagattgctatggggacctggaatgtgaacggaggaaaacaattccgtagcaatctcctggggaccactgaactcactgactggctcctggatgcaccccagctctcaggagcagtggactctcaggacgatggcggtcccgctgacatatttgccgtcgggtttgaggagatggtggagctgagtgcaggaaatattgtcaatgccagcaccaccaacaggaagatgtggggtgagcagctccagaaagccatctcccgatcccatcggtacatcctcttgacctcagcacagctggtgggcgtctgtctttacatctttgtacgtccgtaccacgtcccgttcatcagggatgtggccatcgacaccgtgaagaccggtatggggggaaaggcagggaataagggcgccgtgggtatccgctttcagttccacagcactagcttctgcttcatctgcagtcacctgacggctgggcagtctcaggtgaaggagaggaacgaagactaccgggagatcacgcacaagctctccttcccttcggggagaaacatattttcacacgattatgtgttttggtgtggcgatttcaactaccgcatcgatcttacttacgaagaagtcttctattttgttaaacgccaagactggaagaaacttatggaatttgatcagttacagctacagaaatcaagtgggaaaatttttaaagactttcatgaaggaaccattaacttcggacccacctacaagtatgacgttggatcggctgcctatgacacaagtgacaagtgccggaccccagcctggacagacagggtgctgtggtggaggaagaagcatccgtacgataagacagctggcgaactcaaccttctagacagtgatctagacggtgatgccaacatcagacatacctggtctccgggcactctcaagtactacggccgtgccgagctgcaggcatctgatcacagacctgtgctggccatcgtagaggtggaggttcaagaggtcgatgtgggagcccgggagagagtcttccaggaagtgtcctctgtccaaggcccgctggacgccactgttattgtaaaccttcagtctccaacccttgaagagagaaatgaatttccagaggacctgcgcacagaacttatgcagactttggggaattatgggacgattattctggtcaggatcaaccaagggcagatgctggtgacatttgcagacagccactcagctctcagtgtgctggatgtggatggtatgaaggtgaaaggcagggccgtgaagattcgaccaaagaccaaagattggctagaaggcttgagagaggagctcattcggaagcgggacagcatggcccctgtgtctcccaccgccaactcctgcttgttggaggagaactttgacttcacaagtctggactatgagtcagaaggggatgttcttgaagatgatgaagactacttagcggatgagtttggtcagcctgtagtctcagacagtgagcttggaggagacgactcttctgataccatgagcgcctcgacacctgccagcaagtctcccgcactggctaaaaagaagcaacatccaacgtacaaagctggcttaatggtgaagaagtctgcctcagatgcgtctatctcctccggaacccacgggcaatattccatcttgcagaccgcgaaacttcttccaggagcacctcagcaaccgcccaaggctcgaactggaataagtaaaccttacaacgtcaaacagatcaaaaccaccaatgctcaggaggcggaagcagctatccggtgtctcctggaagctggcggaggtgtcccagagtcagccccgggtgccacgcccctgagaaaccaagggtcttctaagccagaggcctccctggggcctccagtcctaccgcgccggcctgttccaagggttcccactatgaagaaaccaactttgaggagaacaggaaagatcgttttctgctctagctcacaagcttctcaaccttgctcactgctgcaaagacatgagtttgtaaggacagtagccgcccagagactgacacccgtagatgcttccggatcttccgtttgatctcagttctgggagcaggccacttgcccatgttaccagaagaacagtgtgaacagcagcctgtccattttacaatggcttcccaggaaatgaaccttgagacccctcctccaataacagctcccatcccgcctgttcccaaaccaagaacatttcagcctgggagaggtgttgagaggaggccgagtggtggcaagccagaaccggatgacgctcctcctgtgacaggcgctgtggagttatcgtctccagaggccccagaggccccgtccctggctcccaaggtgcctcctaggaggaagaagtctgcaccagcagccttccacctgcaggtcctgcagagcaacagccaacttctgcagggcctcacatgctccagcagttctccgtccccaccaaagcctgacacccccctgctctatccgcaaatggcacttggcacttcatctgctataagtcccgaaactgatggccccagagtgacggagcccgaggcagcctcttttcatggcgattacccagatcccttctggagccttctccaccaccccaagctgttgaataataatacctggctgtccaagagctctgagcctttagacttggggtccaggacccctgagaggacacacacagactcagcgcaggtcaatgcatcagtggttgagagggggcttccaccagaccatgggggtaaagacttcagtcactggatggccgccagtaacaaagacaagaggacaacattaggcgtttgacccacaggcaagaacatggcctgttggctctgtagatgctctcatttcaaacgctcaccttcctcatgtgggcattgcttgacctggtcaaaagggatgttgatgtaaaggcacactgaaaccctttgtttatctgtcactctgtgtagtgaatgaaaactgtctcccattcagtacagttatccagccacccaaacgttccattcaaggtctgtgcattttaagcttgctctcaggacactgggaaatgtgctgttgcattcgggatatggattttaaagggaagaaatctagattcccaagacgctctcatctgcggaattttaagtggttgttcaatatatgtttgtgtgccatttgcttgttggttttgtttgtgtttttacagatttgggataagtggttaggttcataaaagatgacatcaaaagcagtcgggaccttaagagctgttgtgacccacttgaaaccac

SEQ ID NO: 2353 - DNA, 1889 bp, Rattus norvegicus
  Genbank Accession No. NM_032416
gctttatctgctaagctccgctcagttcagcatgctgcgcgccgcactcagcaccgcccgccgtgggccacgcctgagccgcctgctgtccgccgccgccaccagcgcggtgccagcccccaaccagcagcccgaggtcttctgcaaccagatcttcattaacaatgagtggcatgatgctgtcagcaagaaaacattccccaccgtcaacccttccacgggggaggtcatctgccaggtagccgaagggaacaaggaggacgtagacaaggcagtgaaggccgctcaggcagccttccagctgggctcgccctggcgccgcatggatgcatctgacaggggccggctgttgtaccgattggctgatctcatcgaacgggaccggacctacctggcggccttggagaccctggacaacggcaagccttatgtcatctcctacctggtggatttggacatggttctgaaatgtctccgctattatgctggctgggctgacaagtaccacgggaaaaccattcccatcgatggcgacttcttcagctacacccgccacgagcctgtgggcgtgtgtggacagatcattccgtggaacttcccgctcctgatgcaagcctggaagctgggccctgccttggcaactggaaacgtggtggtgatgaaagtggccgagcagacaccgctcactgcactctacgtggccaacttgatcaaggaggcaggcttcccccctggtgtggtcaatattgttcctggattcggccctaccgccggggctgccatcgcgtcccacgaggatgtggacaaagtggccttcacaggttccactgaggttggtcacctaatccaggttgccgccgggagcagcaatctcaagagagtaaccctggaactggggggaaagagccccaatatcatcatgtcagacgctgacatggactgggctgtggaacaggcccactttgccctgttcttcaaccagggccagtgctgttgtgcgggctcccggaccttcgtgcaggaggatgtgtatgatgaattcgtggaacgcagtgtggcccgggccaagtctcgggtggtcgggaaccctttcgacagccggacggagcaggggccgcaggtggatgagactcagtttaagaagatcctgggctatatcaagtcaggacaacaagaaggggcgaagctgctgtgcggtgggggcgccgccgcagaccgtggttacttcatccagcccaccgtgttcggagacgtcaaagatggcatgaccatcgccaaggaggagatcttcggaccagtgatgcagatcctcaaattcaagaccattgaggaggttgtggggcgagccaataattccaagtacgggctggctgccgctgtcttcacaaaggacctggacaaggccaattacctgtcccaagctctgcaggctgggactgtgtggatcaactgctacgatgtgtttggggcccagtccccatttggtggctataagatgtcggggagcggcagggagctgggcgagtatggcctgcaggcctacacggaagtgaagacggtcaccgtcaaagtgccacagaagaactcgtaaagtggcgtgcaggcttcctcagccagcgcccaaaaacccaacaagatcctgagaaaagccaccaccaagcacactgcgcctgccaagagaaaaccccttcaccaaagcgtcttgggccaagaaagtcaggatttgataaacagggcagggttggtgggcggtgtgtggggagcatcccagtaaactggggaagggaggagctctgtgcagactaccacgcgcacgcacacacgctcactgggtccttctgtgctggatgctggttccaccctcagtgcttaaacaaatgagcaataaa

SEQ ID NO: 2354 - DNA, 4422 bp, Rattus norvegicus
  Genbank Accession No. NM_033021
gatcctgggagagtccgacgttcgccggctaacgcaggacaggtcactgaggtccgccaggtgtgtccgccgtttgtttcctgcccctcgccaggttcggtgtccgctgccgaggcccgaggcccttcttccgctgtcggcgcgcccccctgtctcgtttcggccccgccgggacaacgcctggagtcgcagcagccgggtgatcgcgcccgtcatcctctaccaacgtttccaggctgccctgctcgggagtgggtgagaatgaagctaaaggagatagaccgcacagcgatgcaggcgtggagccctgcccagaaccaccccatttacctggccacagggacatctgctcagcagttggacgcgacattcagtaccaacgcttcccttgagatattcgagctcgacctttccgacccgtccttggatatgaagtcctgtgctactttctcctcgtctcacaggtaccacaagttgatttggggacctcataaaatggattccaaaggagatgtttctggagttttgattgcaggtggagaaaatggaaacattattctctacgatccttctaaaattatagctggagacaaggaagttgtgattgcccaaaaggacaagcatactgggccagtgagagccttggatgtaaacatcttccagaccaatttggtggcctctggtgctaatgaatctgaaatctacatttgggatctaaacaattttgcaactccaatgacgccaggagctaaaacacagccaccagaagatatcagctgcatagcctggaacagacaggtccagcatatcttagcatcagccagtcccagtggccgggcaacggtctgggatctcaggaaaaacgagcctattatcaaagtcagcaaccacagtaactggatgcactgctctgggctggcatggcaccctgatgtcgctactcagatggtccttgcttctgaggatgatcgattaccagtggtccagatgtgggatcttcgatttgcttcctctcccctccgggttctggaaaatcatgccagggggattttggcaattgcttggagcatggcagatcctgaattgttgttaagctgtggaaaagatgctaagattctctgctctaaccctaacacgggagaggtattatatgaacttcccaccaacacacagtggtgctttgatatccagtggtgtcctcggaatcctgccgtcctgtctgccgcttccttcgatggtcgcatccgtgtctactccatcatgggagggagcatagacggcttaaggcagaaacaagttgacaagctttcgtcgtcttttgggaatcttgatccgtttggcacaggacagccgctccctccattacaaatcccacagcagacttcacagcacagcatcgtgctgcccctgaagaagccgcccaagtggatccggagacctgtgggcgcctccttctcattcggagggaagttggtgactttcgagaacgttacagggcagcctcagcagggagctgagcagccacggcggcagcccgtgttcatcagtcaggtggtgacagaaaaggacttcctcagccgctcagagcagctacagcacgtcgtcgagtctcagggctttatcagttactgccagaaaaagatcgatgcgtcccagactgacttcgagaagaatgtgtggtccttcttgaaggtaaagtttgaggaggattctcgtgggaaataccttgagcttcttggatatagaagagaagatctgggagagaagattgctttggccttgaacagagtggacggatccgatgtggctcttaaggactctgaccgcgtagcgcagagtgatggggaggagagccctgccgaggaagggcagctcctgggagagcgcattaaagaggaaaaacaggagtgtgactttctgccctcggctggcggtgggacctttaacatctccgtcagtggggatattgatggtttaattacccgggctttgctgaccggcaattttgagagcgcagttgacctttgtttacacgataaccgaatggctgatgccatcatattagccatcgcaggtgggcaggagctcttggctcaaacgcagaagaaatactttgcaaaatcccaaagcaagattaccaggcttatcactgcggtggtgatgaagaactggaaggagattgttgaatcctgtgatcttaaaaattggagagaggctttagctgcggtcctcacttatgctaagccagatgagttctccgccctgtgtgatctcttgggagccaggcttgaaagtgaaggagacagcctcctgcggactcaggcctgcctctgctatatctgtgccgggaatgtagagagattagttgcttgttggaccaaagctcaagatggtagcaaccccttgtctctccaggatctgattgagaaagttgtcatcctccgaaaagctgtacagctcacgcaagccctggacacgaacactgtcggggctcttctggccgagaagatgagtcagtatgccaacttgttggcagcccagggcagcattgccgcggccttggcgtttctgcctgacaacaccaaccagccagatatcgtgcagctgcgtgacagactctgcagagctcaaggcaggtctgtgccggggcaggagtcctctaggagctcctacgaggggcagccgctgcccaagggcgggcccgggccgtttgctggtcacccgcaggtgtccagagttcaaagtcagcaatattatccccaggttagaattgcccctactgtcactacctggagtgacagaactcccactgccctccccagccatccacctgcagcctgtccctctgacacacagggagggaatcctccacctccaggtttcataatgcatggcaacgttgttccaaatagccctgccccactgccgacgtctccaggccacatgcacagccagccaccaccttatccgcagccgcagccttaccagccagcccagcagtattccttgggaacaggggggtcagcagtttatcgacctcaacagcctgttgctcctcctgcttctaagcgttaccctaacgccccatacgtatctcctgtcgcttcctactccgggcagcctcatatgtacacagcacagccagcctcctcccctacctccagctctgctcctcttccccctcccccttcctctggagcgtccttccagcatggcggaccaggagctccaccgtcatcttcagcttatgcactgcctcctggaacaacaggtacaccgcctgctgccagtgagctgcctgcgtcccagagaacaggtcctcagaatggttggaatgatcctcccgctttgaacagagtaccgaagaagaagaagctgcctgagaacttcatgcctcctgtccccattacgtcaccaatcatgaaccctgggggagatccccagccacaggggctgcagcaacagccttcagcttcagggccacggtcaagccacgcctccttcccgcagccgcacctagccggcggccagcccttccacgggatccagcagcctcttgctcaaacaggcatgccaccgtctttctcgaagcccaacactgaaggggcccccggcgctcccattgggaacaccatccagcatgtgcaggctctgccaacagaaaaaattaccaagaagcctattccagacgagcacctcattctaaagactacgtttgaggaccttatccagcgctgcctctcctcagctacagacccccaaaccaagaggaagctggacgacgccagcaaacgcctggagtgtctgtacgacaaacttagggaccagacactttctccaacaatcatcagcggtctccacagcattgcgaggagcattgagacgaggaactactctgaagggttgaccgtccacactcacatcgtcagcaccagcaacttcagtgagacctcagccttcatgccagtcctcaaggttgtgctcagccaggccagtaagctgggcgtctgagacagctgccatgacctccgactccgccacttctccaaagaaagccatgctaagactgggaccagcccctcattagcatgtttccatggcacccgccacccaggagctttgacatttctgcaggcaaactcccctagaactgcttgaaccccccctcccaccccgcccgtgctttcctttgttttaatcccctcgcccattatgattttcccattctgcaaatagtgtctttcctggattacacatagtgtggtttcctgagggattctgacaaaatgtggtttttaaaacttgggtgtactttttaggaaaattgcatctggctgtgtataaaacagacctaaaatagatttctttaatgtcttccctaccttcttcacgttcatcagattaaagttgtaatcccatctt

SEQ ID NO: 2355 - DNA, 3257 bp, Rattus norvegicus
  Genbank Accession No. NM_033096
ggcacgagcgctgctcaatggcggaaaagccgctggtactctgaccgcctggtcccccctggcagttgcgggggagtttcctgccggcgcggctggagtctctgtttctctgtgtccggtggctggaagatgctccagagagatcaggctgcggcggaggaggtggcggcggccgagtcggcagcggcgctgggttggagagaaggcggcggcggcggcgtgaggggccggacggtgtaaacagctcgggcggcggcggtggccgagcccccgagggcgaagcggcggcggaggcggtgtcgcgtctcgggagaaagccgggggccgcgggcggctgtgcggcgggcaagcccgcgagaccttgccttccaccttcgccccagattcgttactaaacatgggtgcatttttggataaacccaaaactgaaaagcacaatgctcacggtgcagggaacggtctgcgttacggtctgagcagtatgcaaggatggagagtagaaatggaagacgcacacactgctgttgtgggaattcctcacggcttggaggactggtcgttttttgcagtctatgatggtcatgctggatcccgagtggcaaattactgttcaacacatctattagaacacatcactaccaatgaagactttagggcagctgacaaatcaggctttgctcttgagccgtcagtggaaaatgttaagactggtatccgaactggctttttgaaaattgatgaatatatgcgtaacttttcagacctgaggaacgggatggacaggagcggctctaccgcagtgggcgtgatgatttcaccgacacacatctactttatcaactgcggtgactcgagagctgttctatgtaggaatggacaagtctgcttttctacccaggatcacaaaccttgtaatccaatggaaaaggagcgcatccaaaatgcaggaggcagtgtaatgatacagcgtgtgaatgggtcgttagcagtgtctcgtgctctgggggactatgattacaagtgtgttgatggcaagggccccacagagcagcttgtttctccagagcctgaggtttatgagattctaagagcagaagaggatgaatttgtcgtcctggcttgtgatgggatctgggatgtgatgagcaatgaggagctctgtgagtttgttaactctaggcttgaggtgtcagacgacctggagaatgtgtgcaattgggtagtggacacttgtttacataagggaagtcgagataacatgagtattgtgttagtttgctttgcaaatgcccccaaggtctcagatgaagccgtgaaaagagatttagagttggacaagcacttggaatcacgggtggaagaaatcatgcagaagtctggagaggaaggaatgcctgatcttgcccatgtgatgcgcattttgtctgcagaaaatatcccaaatttacctcccgggggaggcctcgctggcaagcgcaatgttattgaagctgtttatagtagacttaatccaaacaaagacaatgatgggggcgctggcgatctagaagactcattggtagccttataaccttctaaatgcttttgattctgaaaattgggggaaaacttttaatcatattttcttcaatacaaggggaactattcttgtgaattcccactgttttgtggtatgagcagaagccattagcatttcccaccatttgctcatgtttgtacttcccagtaatcgccactcttagcactgcctggactcaacagtattctcgccagcctcaggcctctgcttacaactgtattgaatttttggccctagaaaaacaaaatgaccctacaaatcaacaagtgtgcctgaggtgcatgggaatatagttagctatactctgaagatacgttaagggtttgtttgtttggttgttttttaaaagcaaaacaaaacaacaacatagaagcatgtaagagtaaaggattgcaagagaagttcagtttttcagtttactaagttggaagcctttcgttagttctgtggcttggaatttcatttgagcaatatactataggatatgtatttattattaattgttatttaatttttttccaatttacttgtattaccaaattgggttctccaataatgtaacattgccttgcttcaagatccattgtttggcaataatataaacccttaaagatttccgcatgtgtctgctacatcgttcagatcttactagaagatcttttgaaaccaagtgagttaatttaaggctatttataatttgctttgtcatcttactggcttcgcattattttaattgatgagatttacctttataatgtaaattgtaatcttcttgttttacatgtggatttctatagttttaattttttcagcttttaagatacaagttttatgtaatttggtataatttttaactgtttatgttattttaaaagctcagaatatcacatcaaaatactataaatacattttaaagtatctattttagatctaaggaaatacagagatattttcatgggttcagtaacctttcattttataacattgggcacggtacagagtggctgtcacatcggtacttaaattatttagttctatttttacaataactttaaattttttaagttttgcatgtattgaatttagtgctgaacatgaagagtaaactatttaccaaaaagaagttcctggagtttggagaagtaacgaatgtatccatctgtacatgatttacatgttgtggatgctttgtaaacatttccccatgttttaattgtgtttcagcaggttgtaattgcctctgtgtgtagctgaacatgagtcattatctggtcctgtatgaaatggaatgtatggtattttctgtatcattttcctgaggctgtgtttggggagccacacattcgaatacagttttcctgatcacttgatttcttgtgcacctgatttttgctctcaaaggaattactgccacaatatattttatttattctttagattttagccttgtcagttgaagtgcttcacatgatggtgttaaaaactacttgtccctttactgggggtttgggggttgttaaaagatggggaggaagaatgcaaatgggtcattgttaacctgtccccactgatcccacctgtactcatagtcccttccaggatggtattctgatgtttcctacaatacggtgaccataggcaacttgttacctgaataaaggatcgattttaaacagcc

SEQ ID NO: 2356 - DNA, 620 bp, Rattus norvegicus
  Genbank Accession No. NM_033234
tgcttctgacatagttgtgttgactcacaaactcagaaacagacaccatggtgcacctgactgatgctgagaaggctgctgttaatggcctgtggggaaaggtgaaccctgatgatgttggtggcgaggccctgggcaggctgctggttgtctacccttggacccagaggtactttgatagctttggggacctgtcctctgcctctgctatcatgggtaaccctaaggtgaaggcccatggcaagaaggtgataaacgccttcaatgatggcctgaaacacttggacaacctcaagggcacctttgctcatctgagtgaactccactgtgacaagctgcatgtggatcctgagaacttcaggctcctgggcaatatgattgtgattgtgttgggccaccacctgggcaaggaattcaccccctgtgcacaggctgccttccagaaggtggtggctggagtggccagtgccctggctcacaagtaccactaaacctcttttcctgctcttgtctttgtgcaatggtcaattgttcccaagagagcatctgtcagttgttgtcaaaatgacaaagacctttgaaaatctgtcctactaataaaaggcatttactttcactgc

SEQ ID NO: 2357 - DNA, 1403 bp, Rattus norvegicus
  Genbank Accession No. NM_033236
gggcttgcggcttctaaaatgccggattacctaggtgcagaccagcggaaaaccaaagaggatgagaaggacgacaagcccatccgagctctggatgaaggggatatcgccttgttgaaaacttatggccagagtacttattcgaggcagatcaagcaggttgaagatgacattcagcaacttcttaaaaaaattaatgagctcactggtatcaaagagtccgacactgggctggcccctccagccctctgggatttggctgcagacaaacagacacttcagagtgaacagccgctacaggttgcaagatgtaccaagataatcaacgccgattcagaggacccgaaatacatcatcaacgtgaagcagtttgccaagttcgtggtggatctcagtgatcaggtggcacctactgacattgaggaagggatgagagtcggcgtggacagaaataaataccaaattcacattccactgcctcctaagattgacccaacagttaccatgatgcaggtggaggaaaaacctgatgtcacatacagtgacgttggtggctgtaaggaacagattgagaaattgcgggaagtggttgaaacccctctactccatccagagaggtttgttaaccttggaatcgagcctccgaagggtgtgttgttatttgggccaccaggcacaggcaagaccctctgtgccagggcagtggccaatcggactgatgcttgcttcatcccagttatcgggtctgagcttgtacagaagtacgtcggtgagggggctcgaatggttcgggagctttttgaaatggccaggacaaaaaaagcctgccttattttctttgatgaaattgatgccattggaggggctcggtttgacgatggcgctgggggtgacaatgaggtgcagaggaccatgttggagctcatcaatcagctggatggctttgatcctcggggcaacatcaaagtgctcatggccactaaccgacctgatactctggacccagcgctgatgaggccagggaggctggacagaaagattgagttcagcttacctgacttagagggtcgaacgcacatctttaagattcatgctcgctcaatgagtgtggaaagagacatccgatttgagctactagcccgcctgtgtccaaacagtactggagcggagattagaagcgtttgcacagaggctggtatgtttgcaatccgagcccggagaaagattgctacagagaaggacttcttagaagctgtaaataaggtcatcaagtcgtatgccaaatttagtgctactccccgctacatgacatacaactgagccacagaggctttgactgaaggaacttcctgtgcgttcataacttgttaccgcctcacaaaaataaaagacttaaaaactgt

SEQ ID NO: 2358 - DNA, 699 bp, Rattus norvegicus
  Genbank Accession No. NM_033237
cgagggatcctcgtgcgcttccctacgccgctgatctgcgccatgcagtgagcgaccctcgcgcccgccactctacgccacgcctggacggagacacttggacctgcactaaccagctacgcccggttcccaccactgctcaagatggccaggggcagcgttatcctgctagcctggctcctgttggttgcaaccctgtcagccactctggggctcgggatgccaacaaaggagaagagaggctggaccctgaacagcgctggctaccttctgggcccacatgccattgacaaccacagatcatttagcgacaagcatggcctcacaggcaagagggagttaccactggaagtggaggaagggagactaggaagtgttgctgtgcccctgcctgagagcaatatcgtccgcactataatggagtttctcagtttcttgcaccttaaagaggccggggccctcgacagcctgcctggcatccccttggccacctcctcagaagacctagagcagtcctgagaccacacccactgtgcacctgtgtcctctgctataatttaaagtcattctaggctaaaaagaatcttccgccaactcctcaagccaacactttgttctctgctttgatgctgagttattacaattaagatgttttgattggagtaattatattgtgtgacataataaaaactagcaagt

SEQ ID NO: 2359 - DNA, 1552 bp, Rattus norvegicus
  Genbank Accession No. NM_033351
tcagttctgtaattaattaactaacgtggatcaaatgagaaggtgaaagttcacacaggagcactcctgtcgtcttggactgggtctccatcccaccatccagtgccctggtctacgaagagtccacagggaccttgtgaagaatcaacaaggcggggtccagaggagtcacgtgtgccttccactccgggtcgccctgtcaggatggggatgtcccagcccggggtcctcctcagcctcttattggtcctcctgcctcagacctggggagcggagccccgtctcccactgatgtatcatcttgcagctgtgtctgacttatcaacggggcttccctctttctgggccacgggctggctgggtgctcagcaatatctgacctacaacaacctgcggcaggaggctgacccctgtggggcctggatatgggaaaaccaggtgtcttggtattgggagaaggagaccacggatctgaaaagcaaagaacagctcttcttggaggccatcaggaccctggagaaccaaataaatgggaccttcacactgcagggcctgctgggctgtgaactggcccctgataattcttcattgcccacggctgtgtttgccctcaatggtgaggagttcatgcggttcaacccaagaacgggcaactggagtggggagtggccggagacagatatcgttggtaatctgtggatgaagcaacctgaggcggccaggaaggagagcgagttcctgctaacttcttgtcctgagcggctgctaggccacctggagaggggccgtcagaacctggagtggaaggagccgccatctatgcgcctgaaggcccgtcctggcaactctggctcctcagtactgacctgtgctgctttctccttctacccgccggagctcaagtttcgattcctgcgcaatgggctagcctcaggctctgggaattgcagcactggtcccaatggtgatggatctttccatgcatggtcattgctagaggtcaaacgtggagatgaacaccattaccaatgtcaagtggagcatgaggggctggcccagcctctcactgtggacctagattcgcccgccagatcttctgtgcctgtggtcggaatcattcttggtttattgctggtggtagtggccatcgcagggggtgtgctgctatggaacaggatgcgaagtgggctgccagccccatggctttctctcagtggtgatgactctggcgacctattgcctggtgggaacttgcccccggaggctgaacctcaaggtgtaaatgcctttccggccacttcctgatgccaacccaggccccatacccattgcagcctgtggggctgtgtgacctcctgaactgtctctgagcctcccgagggagccctgggctggatgtcctcctcgtggatcccttcttttgtggcctgcttcagtttcccctcttaatgtcaatggctatttccatctccacataaatttgggcccaaatctgtgtgtgcatcgttattctcaggtttcaggcagccggaataaattgaacaagtttgag

SEQ ID NO: 2360 - DNA, 5531 bp, Rattus norvegicus
  Genbank Accession No. NM_033352
  misc_feature (1)..(5531): n = a or c or g or t
gagggactcgcccccggtggatgcggtggagtttgagctttttgctgcatccgtccctgaagaacaaaataagagtaagggagacaagctgcagagcatgggaggctgtggggttttctgaaacgtttgctgggctctccgcggagcatgagcttttaaaaggagttctttggagagaaatccatttgtgttagctggaaaaatgatacacatgctaaatgcagcagcctatcgggtgaaatggaccagatccggtgctgctaaaagggctgcctgcctggtggctgcggcatatgctctgaaaaccctctatcccatccttggcaggcgtttaaagcagcctggccaccggaaggcgaaagcagaagattacccgcctgcagagaacagagaaagactgcattgcacagagatcatctgtaaaaaacctgcgccgggactaaatgcagattttttcaaacagctactagaacttcggaaaatcctctttccaaaacttgtgaccactgaaacggggtggctctgcctccactcggtggctctaatctcacgaacgtttctgtctatctacgtggctggtctggatgggaaaatcgtgaaaagcatcgtggaaaagaagcctcggactttcatcatcaaactagtcaagtggcttatgattgccgtccccgctacctttgtcaacagcgctatcaggtacctggagtgcaaactggcattggcctttagaactcgcttagtggaccatgcctatgagacctattttgcaaatcagacttattataaggtgataaatatggacgggaggctggcaaaccctgaccagtctcttactgaagacattatgatgttctcgcaatcggtggctcacctgtattccaaccttaccaaaccgattttagatgtaattctaacctcctataccctcatccggacagctacatccagaggagcaagccccatcgggcccaccctgttagcagggctcgtggtgtatgccactgctaaagtcctgaaagcttgctcgcccaaatttggtactctggtggctgaagaagctcatagaaagggctacttgcggtatgttcactccagaatcatagccaatgtggaagaaattgccttctacagaggacataaggtagaaatgaagcaactgcagaagtgttacaaggctttagcttaccagatgaaccttattctatccaaacgtttgtggtacatcatgatagaacagttcctgatgaagtatgtgtggagcggctgtggactaattatggtggccatacctatcatcactgcaacaggctttgcagatggtgatctggaggatggccctaagcaggctatggttagcgatcggacagaggcctttaccactgctcggaatttactggcctctggagctgacgcgattgagaggattatgtcttcatacaaagagatcactgaactagcgggttatactgccagagtgtacaacatgttctgggtcttcgatgaagtgaagagaggcatttataagagaactgtcactcaggagcctgaaaacaatagcaagagtggaggtggcctggagctgcccctcagtgacaccctggcaatcaaagggacagtcattgacgtggatcatggaatcctttgtgaaaatgttcccataatcacgccggcgggagaagtggtggcttccagtctgaacttcaaagtagaagaagggatgcatcttttgataaccggccccaatggttgtgggaaaagctctctgttcagaatcttaagtgggctctggcctgtgtatgaaggagtcctttataaaccacctccccaacatatgttctatattccacagaggccgtacatgtctcttggaagtcttcgggatcaagtcatttatcctgactcggtggatgacatgcatgagaaaggttatacagaccgagacctagagcatattctgcacagcgtccacctctaccacatagtccaaagagaaggaggatgggatgcagtcatggattggaaagatgtcctttcaggaggggagaaacagagaatggggatggcacggatgttttaccataaaccgaagtacgcattgctggacgagtgcaccagtgctgtgagcattgacgtggaaggaaagatatttcaggctgctatcggggctggcatttccttactgtctataacgcacaggccttctctgtggaaataccacacccacctattgcaatttgatggcgaaggaggttggcgctttgaacagttggacactgctatccgcttaacgttaagcgaggagaaacagaagttggagtcgcagctcgctggaattcccaaaatgcagcagagactcaatgaactgtgcaaaattttgggggaagactcggtgctgaaaacgatccaaactgcagaggacacatcctaactgaccttgacatgttttaagttaacttctaggtgatgcctcagagactctttctttactgcatgcagtatgttaagctaagtgaagagaaagcaagccagcaaaaaaaaaaaaaaaagtattttgtatgatttcagcatcgaggaaatatgataactttttcgaatgaaaaaaaaagcgaacgaattagttgcggttagtcatgactcaggttagtgccccgtgagaggctagctcacctgtaaagtgggtttctagattaggagagtgtgtgtggttcttcctaggagagaatgccccaaaacaagacagcaggggcaccagctgggccgatgtcaggaattagacctttgagggctctttcaacccaggtaacggggacaataggtgcaacacctggaatctatagtcagcattgctaggggccaactcaaactgtgtacaaagtagcaggctgtttgatacatagtttcagtctgaaaagggtgtatccgaatgacagtggttgaaaacaagcacggctagacaagtataaagtactgtattaaattttttcataccttgagcatcttaatacagatacagaaattaacattaataaaaattgtgtgtatgtgtttaaaaaaaaacccttttatgttttaaaaagagaattgcccatacagaagaggacggtctgaacgatatttgttctggctaccgcttgactctgcagtcctatttagtacggtttctgtccagaaatactgtctgtctggtgcccaaaatggcattttagaaacttgattgctgccctaaatatggatcctggaaatcacagttatgttcctacattcattttaccttactccatcttttaagacatacaagtttttgttcctttttcttctgaaacgcgcgcgcgcacacacacacacacacacacacacacacacacacacacacacacagatttactttaatcacatgatttattttggaagagctgtagcgatcatgaaggtctccctcccccacacaccagacccagtgctgtcatcactaatggcccttaaatttaactgggatataatgtcagttttaaaangatgtggaccaggcagatggccagaaatggttgtaggcaaagcagggcataagggaaaaaattaaagcagataaataaatattattcaggcatagaagagtgacagttgcttctcttgtaggggacctgagttccattgccaacatccacatggtggctcaaacgtgtgtctaattccagctccaggggatctgacatacatgtagactccagggatcctgcatacatgtagtcctcatacacacatacatgcagacaaaacattcatagcattaaaaatcaataaatctgaaagatagtaaggatattgaaagctggcaatgttgatgttaccatcacttaattactgtttgcgagaagtgaaaattgagtgagaaatgcaatgggcgttggtcaacgcagctcggctgtgcacacccacctgatgccgaagtgtctgcagtgccagcgctcaggagggcagtacattgcacttccggtaagcttcacgctgctgaagatgacagagaccctcacatcatatgaaatacagtgcatctggagtacaaaaccacgactaatgctttaatctcatcctctctcagacatgacgaggtatgtgaaaacccgagatgaacagttttaggggcttaaggttttgtttctgtattcagacagcgctttagcagacactaactctcgataacagacggtttggaagacagaccccctagaagtcattcacaatgatggtcgtgagaaattgcagcatttccacattttcaattccgcaaaaatctacacaatttgaattaccaatcactgtgaccaccttacacaaaacaatacaaggtcataatcagtacctttgtatttgtctgttactgctacttcttactaataatgtgggacactaatgaaatatttggtttagcaaaagtataaaaccagaaattgacactgaattaaaaaaaaaaacacacaattcactaatctcttaacaaccgtgctagcagttacccaggttatagtgctaaaggagaatcatttgaagcaagggtcttatattagctctgacaagcacaagaggaaaattgaaagttcacatttgaaattataccatttcagacttaaaataaaccatgtaagacctgatatcctacgttttcaagctttgcgaaagatgccaacatcaatgctacattcggaactagaccttatttagtagaggttaccagcgagctggatcgaaataaataagactcgttacacagtggatgggggttcaacgatgtttggaattcggtactaaaactctagtcacgaaatttaaacgttaaggtttcaggactaactgtttcccagtagccttttggtaactactgatttaatgctggatatctttttttttcttttttttctttttttttccagagctggggaccgaacccagggccttgcgcttcctaggcaagcgctctaccactgagctaaatccccaaccccactactgattttctgaactgcctcttctgagccagagtaccctccgtcttagagggagaacccgatgtggatctgtgttgtgtataatctgactctttccaaagtgctcccacgggagaccagagctgatactctgacaggcatacttgtgaaaacacaaagaccactgagacctcttctttgactaggacaaagaataataaggaagacgaaggatagcttcatctgtcaaactactttttttttccttagaaaaggcataaatgtatggagttcgattatttcggggaataactcaaaacctgcattgtgacatccgatctctggagcatgctatggtatgccaagcacccaagcacactgtgttcactcttacagacgagataattgctaaaatcctcttgagtcacaaggtcggtgatcgtacttgaaaaccagcccagttcaccctatgtttacacgggaagagttttcctttgatagcaatttgacttttgacccaaattttggcgtgtcaataaaggtataagc

SEQ ID NO: 2361 - DNA, 2122 bp, Rattus norvegicus
  Genbank Accession No. NM_033485
caggcggcggcggcgggagtcaggagtcgcggcgtgaggggcgcccccgccggcccctctgggaacatggcgaccggcggctatcggagcagcggcagcaccacggacttcctggaggagtggaaagcgaagcgcgagaagatgcgcgccaagcagaaccccgtgggcccgggttcgagcggcggggatccagccgccaagtcccctgcgggaccgctcgcccagactacggccgcggggacctcggaactcaaccacggccccgccggcgcggccgcacctgccgcccccgggccgggcgccctgaactgcgctcacggctcgtccgcgctgccccgcggggctcccggctcccggcggccggaggacgagtgtcctattgccgctggggccgcgggagcacccgcgtcccggggagacgaggaggagccggatagcgccccggagaagggccgcagctcggggcccagcgccaggaaaggcaaagggcagatcgagaagaggaagctgcgggagaagcgccgctccaccggcgtggtcaacatccccgcggcggagtgcttagatgagtacgaagatgacgaagcaggacagaaggaacggaagcgagaggatgctatcacacagcagaacaccatccagaatgaagctgcgagcctcccagatccaggaacctcctacctgccccaggacccgtcgagaacagtcccaggcagatacaaaagcacaatcagtgccccagaagaagaaatcttaaatagatatccccgaacagatagaagtggcttcagtagacacaacagagataccagtgcgcctgctaacttcgcttcaagtagcaccttggaaaagagaattgaagatcttgagaaggaagtcttgagagaaaggcaagaaaaccttcgacttacgaggctgatgcaagataaagaagaaatgattggaaaactcaaggaagagattgatttgttaaatagagacctcgatgacatggaagacgaaaacgagcaactaaagcaggaaaataaaactcttttgaaagttgttgggcagctgacaaggtagaagacgcaaggctgcctcggtgtgggaaacctgcttttaaaccgcggatgaatgtcatggcgaaggcgcccgtgattcagtgcgctgagagaactgtatatttatttctagaaaacacatggatctcttcttctcaaaatttactctttctcattactagtttttaaaaagtgtaaatccccgtctttcaacatagaagttaacatctttagctattaaaatgataggtgatgcctcttggttctgtgtgatactcagataatatatggttcgaagtagcagccatttgcatatgttttatctatgttagcacatattctccctaaaggaagatgcatagtctttgtttacatgaattcaaatccttgggggagttgcctacagatgccctattactaatgtgtgcgccttccgtgtgctaatgcctactcataaagacgcatctgccgtctcgtcctcccacgggctctcctgattccgagtggtaatagatacactactttgtatagcagtaatcgttcaaaggaaagctattttgcagttatttcatatgttctagttggctaaatataaacttaagaaaatacttgaactgtgttatagtaagtgaaaaattactattttgtgtttgaatattgaaaaaaaatttcagtaacttctgaaaaacagttaatgtatagtttcttatgtaggtactatcattcctttttttttattgctctagggtttactagtaaataatgggatatttaaaaagttgtttattcttcaggcctcaattgtgtacaatttcagtattgaagaagaaaattgatgctgtgaatagcatgtgcttcaaaaatcagaactaaaaaatttttccacacttaaaatatgtacacatacgtcagcatgtgtaagcagagataacacagatatctcagccgattcctgagttggagacaccctgggatgctttttgtcaatagagaatcatcccataaccctaacactgaagattttaaagcaaccatatttgaagatttataaaataaagttgtcttctattaaaaaaaaa

SEQ ID NO: 2362 - DNA, 1404 bp, Rattus norvegicus
  Genbank Accession No. NM_033539
ggatccaaaaatgggaaaggaaaagactcacatcaacatcgtcgtaattggacacgtagattccggcaagtccaccacaaccggccacctgatctacaaatgtggtggaatcgacaaaagaaccattgaaaagtttgagaaggaggctgcggagatgggaaaaggctccttcaagtatgcctgggtcctggacaaactgaaagctgagcgtgagcgtggtatcactattgacatctccctgtggaagtttgagaccagcaagtactatgtgactatcattgatgccccaggacacagagacttcatcaagaacatgattacgggcacatctcaggctgactgcgctgtcctgattgttgctgctggtgttggggaatttgaagctggtatctccaagaacgggcagacccgtgagcatgctcttctggcttacactttgggtgtgaaacagctaattgttggtgtcaacaaaatggattccaccgagccaccatacagtcagaagagatacgaggaaatcgttaaggaagtcagcacctacattaagaaaattggctacaaccctgaccacgtagcatttgtgccaatttctggttggaatggtgacaacatgctggagccaagtgctaatatgccgtggttcaagggatggaaagtcacccgcaaagatggcagtgccagtggcaccacgctgctggaagctttggactgcattctgccgccaactcgtccaactgacaagcctctgcgactgcccctccaggatgtctataaaattggcggcattggcactgtccctgtgggccgagtggaaactggtgttctcaaacctggtatggtggttacctttgctccagtcaatgtaacaactgaagtcaagtctgtggaaatgcaccatgaagctttgagtgaagctctccctggggacaatgtaggcttcaacgtaaagaacgtgtctgtcaaagacgttagacgtggcaatgttgctggggacagcaaaaatgacccaccaatggaagcagctggcttcactgctcaggtgattatcctgaaccatccaggccagatcagtgctggctatgcccctgttctggactgccacacggcccacatagcatgcaagtttgccgagcttaaagagaagatcgatcgtcgttctggtaagaagctggaagatggccccaaattcttgaagtctggtgatgccgccattgttgacatggtccctggcaagcccatgtgtgttgaaagcttctctgactaccctccacttggtcgttttgctgttcgtgacatgaggcagacagttgctgtgggtgtcatcaaagccgtggacaagaaggctgcaggagctggcaaagtcaccaagtctgcccagaaagctcagaaggctaaatgaatatt

SEQ ID NO: 2363 - DNA, 4696 bp, Rattus norvegicus
  Genbank Accession No. NM_052807
tttttttttttttgagaaaagggaatttcgtcccaaataaaaggaatgaagtctggctccggaggagggtccccgacctcgctgtgggggctcgtgtttctctccgccgcgctctcgctctggccgacgagtggagaaatttgtgggcccggcattgacatccgcaacgactatcagcagctgaagcgcctggaaaactgcacggtgatcgagggcttcctccacatcctgctcatctccaaggccgaggactaccgaagctaccgcttccccaagctcacagtcatcaccgagtacttgctgctgtttcgagtggccggcctcgagagcctgggagacctcttcccgaacctcacagtcatccgtggctggaaactcttctacaattacgcactggtcatcttcgagatgaccaatctcaaggatattgggctttataatctgaggaacattactcggggggccatcaggattgagaaaaacgctgacctctgttacctctccaccatagactggtctctcatcttggatgcggtgtccaataactacattgtggggaacaagcccccaaaggaatgtggggacctgtgtccagggaccttggaggagaagcccatgtgtgagaagaccaccatcaacaatgagtacaactaccgctgctggaccacaaatcgctgccagaaaatgtgcccaagtgtgtgtgggaagcgagcctgcaccgagaacaatgagtgctgccacccggagtgcctaggcagctgccacacaccggacgacaacacaacctgcgtggcctgccgacactactactacaaaggcgtgtgcgtgcctgcctgcccgcctggcacctacaggttcgagggctggcgctgtgtggaccgggatttctgcgccaacatccccaacgccgagagcagtgactcagatggcttcgtcatccacgatggcgagtgcatgcaggagtgtccatcaggcttcatccgcaacagcacccagagcatgtactgtatcccctgtgaaggcccctgccccaaggtctgcggcgatgaagaaaagaaaacgaaaaccatcgattctgtgacgtctgcccagatgctccaagggtgcaccattttgaagggcaatctgcttattaacatccggcgaggcaataacattgcctcggaattggagaacttcatggggctcatcgaggtggtgactggctacgtgaagatccgccattcccatgccttggtctccttgtccttcctgaagaaccttcgtctcatcttaggagaggagcagctagaaggaaactactccttctatgtcctggacaaccagaacttgcagcagctgtgggactggaaccaccggaacctgaccgtcaggtcagggaaaatgtacttcgctttcaatcccaagctgtgtgtctctgaaatttaccgaatggaggaggtgacaggaacaaagggacggcagagcaaaggagacataaacaccaggaacaacggagagcgagcttcctgtgaaagtgatgttctccgtttcacctccaccaccacctggaagaaccgcatcatcataacgtggcaccggtaccggccgccggactaccgggatctcatcagtttcacagtctactacaaggaggcaccctttaaaaacgtcacggaatacgacgggcaggatgcctgtggctccaacagctggaacatggtggacgtggacctgcctccgaacaaggagggggagcctggcattttgctgcatgggctgaagccctggacccagtatgcagtctatgtcaaggctgtgaccctcaccatggtggaaaacgaccacatccgtggggccaaaagtgaaatcttgtacattcgcaccaacgcttcagttccttccattcctctagatgtcctctcggcatcaaactcctcctctcagctgatcgtgaagtggaaccccccaactctgcccaatggtaacttgagttactacattgtgaggtggcagcggcagccgcaggatggctatctgttccggcacaactactgctccaaagacaaaatacccatcagaaagtacgccgatggtaccatcgatgtggaggaggtgacagaaaatcccaagacagaagtctgcggtggtgataaagggccgtgctgtgcctgtcctaaaaccgaagctgagaagcaggctgagaaggaggaggctgagtaccgtaaagtctttgagaatttccttcacaactccatctttgtgcccagacctgagaggaggcggagagatgtcctgcaggtggctaacaccaccatgtccagccgaagcaggaacaccacggtagctgacacctacaatatcacagacccggaagagttcgagacagaataccctttctttgagagcagagtggataacaaggagaggactgtcatttccaacctccggcctttcactctgtaccgtatcgatatccacagctgcaaccacgaggctgagaagctgggctgcagcgcctccaactttgtctttgcaagaaccatgccagcagaaggagcagatgacattcctggcccagtgacctgggagccaagacctgaaaactccatctttttaaagtggccagaacccgagaaccccaacggattgattctaatgtatgaaataaaatacggatcgcaagtcgaggatcagcgggaatgtgtgtccagacaggagtacaggaagtatggaggggccaaacttaaccgtctaaacccagggaactatacggcccggattcaggctacctccctctctgggaatgggtcgtggacagatcctgtgttcttctatgtcccagccaaaacaacgtatgagaatttcatgcatctgatcattgctctgccggttgccatcctgctgattgtggggggcctggtaatcatgctgtatgtcttccatagaaagaggaataacagcagattgggcaacggggtgctgtacgcctctgtgaaccccgagtatttcagcgcagctgatgtgtacgtgcctgatgaatgggaggtagctcgggagaagatcaccatgaaccgggagctcggacaagggtccttcgggatggtctatgaaggagtggccaagggcgtggtcaaggacgagcctgaaaccagagtggccatcaagacagtgaatgaggctgcaagtatgcgtgagagaattgagtttctcaacgaggcctcagtgatgaaggagttcaactgtcaccatgtggtccggttgctgggtgtagtatcccaaggccagcccaccctggtcatcatggaactaatgacacgtggcgatctcaaaagttatctccggtctctaaggccagaggtggagaataatctagtcctgattcctccgagcttaagcaagatgatccagatggctggagagattgcagatggcatggcctacctcaatgccaacaagttcgtccacagagacctggctgctcggaactgcatggtagctgaagatttcacagtcaaaattggagattttggtatgacacgagacatctacgagacggactactaccggaaaggcgggaagggcttgctgcctgtgcgctggatgtctcccgagtccctcaaggatggcgtcttcaccactcattccgatgtctggtcctttggggtcgtcctctgggagatcgccactctggctgagcagccgtaccagggcctgtccaacgagcaagttcttcgtttcgtcatggagggcggccttctggacaagccggataactgccccgatatgctgtttgaacttatgcgcatgtgctggcagtacaaccccaagatgcggccctccttcctggagatcatcggaagcatcaaggatgagatggagcccagtttccaggaggtctccttctactacagcgaggagaacaagcctccagagccggaggagctggagatggagctggagctggagcccgagaacatggagagcgtcccgctggacccttcggcctcctcagcctccctgcctctgcctgaaagacactcaggacacaaggctgagaacggccctggcgtgctggttctccgtgccagttttgatgagagacagccttacgctcacatgaatgggggacgcgccaacgagagggccttgcctctgccccagtcctcgacctgctgatcctcgaccccgaagcacgtgcaaacagtaacgtgtgtgtgtgtgtgcgtgcgtgcgtgtgtgctcactcggtgggcggaggggggagcaggttgtaacaatctattcacaagcctcctgtatctcagtggatcttcagaactgcccttgctgcccacgggagtcggcttctctgcagtaaacacacttgggaccttccttttttcaatatgcaagcagctttttttatttccctacccaaacccttaactgacatgggcctctgcaaaccttaatgacagctcttaatagcaacaggacactcgagaattgagtctcctcattctctgccttttctctcttctgccttccctctctctcctctcccttcccacttccaggctctcctctcttttctccgcttcccagtggaaagcccagcggggaagcctttatttattttttttttaaatcaaattgacttaatggctgccctggggctcctcatcacacctgcctgagcaccataggtctttacaaaaaagaaaggaaaaaaacc

SEQ ID NO: 2364 - DNA, 781 bp, Rattus norvegicus
  Genbank Accession No. NM_053289
aaaccatccagatctctgcaagacagctaaggaggagcagaaagatgatgagagttaagatgttgcatcgcttggccttcccagtcatgtcctggatgctgctctcctgcctgatgctcttatcacaggtgcaaggagaagactctccgaagaaaataccctctgcacgcattagttgccccaaaggctcccaggcatatggctcctactgctatgccctgtttcagataccacagacctggtttgatgcagaactggcctgccagaagagacctgaaggacaccttgtatctgtgctcaatgtagctgaagcttcattcttggcatccatggtcaagaacactggaaacagctaccaatatacctggattggactccatgaccccactcttggtggagaacccaatggaggtggatgggagtggagtaacaatgacataatgaattatgtcaactgggagaggaacccatctactgccttagaccgcggattctgtggcagcttgtcaagatcttctggatttctaagatggagagataccacatgtgaagtgaagttgccctacgtctgcaaatttacaggttaaaattaccagacagcaaacagctttagtttgtcctgaagcacatcctgtcaaggggcaaaatatgaagacttgcgtagaaaaagtgtattctatctacagtccacattggagctctaatcattctttagccaattttgtataagttgtgtcctcatgtcttggaaagcagtaataaacctcagtctctcttcgaa

SEQ ID NO: 2365 - DNA, 1675 bp, Rattus norvegicus
  Genbank Accession No. NM_053291
ggcctctctccgggcctctcgacctcacggtgttgccaaaatgtcgctttctaacaagctgactttggacaagctggacgtgaaggggaagcgggtcgtgatgagggtggacttcaatgttcctatgaagaacaaccagataacgaataaccaaaggatcaaggctgctgtcccaagcatcaaattctgcttggacaatggagccaactcggttgtgcttatgagccacctgggccgtcctgatggtgtgcccatgcccgacaagtactccttagagccagttgctgcagaactcaaatctctgctgggcaaggatgttctgttcttgaaggattgtgtgggctcagaagtagagaatgcctgtgccaacccagcggctgggactgtcatcctcctggagaacctccgctttcatgtagaggaagaagggaagggaaaagatgcttctgggaacaaggttaaagctgagccagctaaaattgatgctttccgagcctccctgtccaaacttggagatgtctatgtcaatgatgcttttgggactgcacacagagcccacagttccatggtgggtgtgaatctgccacagaaggctggtggatttttgatgaagaaggagctgaactactttgccaaggctttggagagtccagagcgacccttcctggctatcttgggaggagctaaagttgcagacaagatccagctgatcaataatatgctagacaaagtcaatgagatgatcatcggtgggggaatggcttttaccttccttaaggtgctcaacaacatggagattggcacatctctgtatgatgaagagggagccaagattgtcaaagatctcatgaccaaagctgagaaaaatggtgtgaagattaccttgcctgttgactttgtcactgctgacaaatttgatgagaatgcaaagactggccaagctactgtggcctctggtatacctgctggctggatgggcttggactgtggtactgagagcagtaagaaatatgctgaggctgtggctcgagctaagcagattgtttggaacggccctgttggggtatttgaatgggaagcatttgccaggggaaccaagtccctcatggatgaggtggtgaaagccacgtctaggggctgcatcactatcataggtggtggagacaccgccacttgctgtgccaaatggaacacagaggataaagtcagccatgtgagcactgggggcggcgccagtttggagctcctggaaggtaaagtccttcctggggtggatgctctcagcaatgtttagtattttcctgccttttggttcctgtgcacagcccctaagtcgacttagtgttttccgcatctccatttggtgttagtgcagctagtggccaagacgagcaccaggaacctaagcagcagctgcacagcatctcagctcgtctttactgcatgggattcattatagttaagtccatttaatttcttagtgactaaaccttgcattaaggcatatatttatactctgcctgtgaaaggaagtgagctgtaaaagcttagctctcttcgctgtatgtagcctctggttagcctgtcactgttcatgacagcatggaaataacgatgaggattccagctgtaggtttgggaggttgatgatattgaaccaataaaagatcccact

SEQ ID NO: 2366 - DNA, 2373 bp, Rattus norvegicus
  Genbank Accession No. NM_053294
cggggctggggggtggagggagtgcccaaggctctcctcgggatgtggagcttcctacccaggagcgccaggaaggccagatcccctggagaagtcatgattttgggagatgcagagtcgtctgtgagaacgtcttcggggagctctctctgggaacgctcgtggctcttgtgaggaaagggctgcggggcttgggtgggtggacggctgggctgcagctatggaccgagagctggcccaggcctgcatcccttctgagcctgcccaagtgtggctgctcccaccatgggctcctcggtgtacatcacggtggagctggccatcgctgtgctggccatcctgggcaacgtgctcgtgtgctgggccgtgtggatcaacagtaacctgcagaacgtcaccaacttctttgtggtatcgctggcggcggctgacattgcagtgggtgtgctcgccatccccttcgctatcaccatcagcaccggcttctgcgccgcctgccacggctgcctcttcttcgcctgttttgtcctggtcctcacgcagagttccatctttagcctcttggctatcgccatcgaccgctacatcgccatccgaattccactccggtacaatggcttggtgacaggtgtgagggcgaagggcatcattgcaatttgctgggtgctgtcgtttgccattggcctgacccccatgctgggctggaacaactgcagtcagaaagacgggaactccacgaagacctgcggcgagggccgggtgacctgtctgttcgaggacgtggtgcccatgaattacatggtttactacaacttctttgcgttcgtgttaacgccccttctgctcatgctggccatctacctacggatttttctggcggcccggagacagctgaagcagatggagagccagcccctgccaggggagcggactcggtccacgctgcagaaggaggtccacgctgccaagtccctggccatcatcgtcgggctctttgctctgtgctggttgccgctgcacatcatcaactgtttcaccttcttctgctccacgtgccggcacgcccctccgtggctcatgtacctgaccatcatcctctcccacagcaactccgtcgtcaaccccttcatctacgcctacaggatccgggagttccgccagaccttccggaagatcatccgaacccacgtcctgaggcggcaggaacccttccaggcagggggttccagtgcctgggccctggcagctcacagcactgagggagagcaggttagcctccgccttaatggccaccccctgggggtatgggccaacggcagtgccacccattccggacggcggcccaatggctacactctggggctggggggtggagggagtgcccaaggctctcctcgggatgtggagcttcctacccaggagcgccaggaaggccaagagcaccctggcctaaggggtcatctggtccaggctagagtaggagcttcctcatggtcttcagagtttgccccttcctgagggaaagacattttaatatttttggttggctggaccaatctcactaagggaagagaaacccaatgggcgcgtggctcccactttgaactacaaagagggggcatgaagttggagcagcatgaagcccagtaagaaaggcctggggtggaggaagcgatgcttctgcttcgtgctacggggccctgtgttaggtcagggctgcagtagcatctgcaaaggcagggcccagttcccctgctccagaagcgtccaaaagctgtcttgtctctctagagcggttgtggcttagaggactggcctggcccgatgctagaatataggagcttcagacctcctgctgtagtacactactctccccagactgtctagggctcagggagctgctggcctagaagtggcacttggctatttctttttcaagaagataaaaatgtgaggaaacccattctattttattgacttcccccctcccctgcctgctgggtctgtggtcaatcctgcctggaacccccccaaccaaggaattgaaggtggtcttcttgggctagcccaagctaccatgcacttagtcacagggctatctctgaccaacaaagctggcctggaagacagcaactatgaagggaaggattccagagcatgggctcaggtcccatgagagagattagagatgtcaagccatggacctgaacctgggtagttcagcgctaccctgtctgaggccctgactactgcctttccttccagagggacttgtttgtttgtttgtggttttttttttccctgaggtaaaataaaatgagccacactgtgttttaaatttgaaaaaaaaaaaaggaattcctcgagtctagc

SEQ ID NO: 2367 - DNA, 1197 bp, Rattus norvegicus
  Genbank Accession No. NM_053302
atgtcagtcatacccagctccaggccggtctccaccttggcacctgacaatgattttagagagatccacaactggacagagctgctccatctcttcaaccaaaccttttctgattgccgcatggaactcaatgagaacaccaaacaagtggtcctctttgtcttctacctggccatctttgtggtagggttagtggagaacgtcctggtgatatgtgtcaactgccgccgctcaggccgggtggggatgctgaacttatacatcctcaacatggccgtcgcggacctgggcatcatcctgtctctgcctgtttggatgctggaggtcatgctggagtacacctggctctggggcagcttctcctgtcgcttcattcattatttctaccttgccaacatgtacagcagcatcttcttcctcacctgcctcagcattgaccgctacgtcaccctcaccaatacctctccctcctggcagcgccaccagcaccgaatacggagggccgtgtgcgcaggcgtctgggtcctctccgccatcatcccactgcctgaggtggtacatatccagctgctggatggctccgagcccatgtgcctcttcctagcaccttttgaaacgtacagcgcctgggccctggcagtggccctgtcggctaccatcctgggcttcctactgccttttcctctcatcgcagtgtttaatatcctgtcagcctgccggcttcggaggcaagggcagacagagagcaggcgccactgtctgttgatgtgggcttacatagttgtctttgccatctgctggctgccctaccacgtgactatgctgctgctcactctgcacacaacccacatcttccttcactgcaacctggttaacttcctctacttcttctacgaaatcactgactgcttctccatgctacactgtgtcgccaaccccatcctctacaactttctcagcccgagcttccggggccgactgctgagccttgtggtccgttaccttcccaaggagcaggccagggcagcaggcggtcgagcctcctcttcatcttccacccagcactccatcatcattaccaaagagggcagcctgctcgctgcagcggatctgcacacccacgccatcagaaacgtgcaggcctcctctctgcctccgaacacctcacctacactctgcaattccatagccagctaa

SEQ ID NO: 2368 - DNA, 1994 bp, Rattus norvegicus
  Genbank Accession No. NM_053309
ggcacgagcgggagggaccggcggctccgcccgagcgcggccgcccagccccgggccgcccagccgcccagcccccgccctcccgccggcccgcgcctggcggcggccccgacaccgacagagcagccgcgctgccggcggaatggagcggcgccggggctgagccgggcgcactcgggccgccgcatgtgccgcgcggggagcagctgccgagcgggcggagagcgaacgccaggggccccgtcggagcggccacaggagcagcgccggagatgggagagcagcccatcttcaccacgcgagcgcacgtcttccagattgaccccagcaccaagaagaactgggtgccggcaagcaagcaggccgtcactgtttcctacttctacgatgtcaccaggaacagctatcggatcatcagtgtggatggagccaaggtaatcataaacagcaccatcaccccgaacatgacgttcaccaaaacttcacagaagttcgggcagtgggctgacagcagggccaacaccgtgttcggtctgggattctcctcagagcagcagctcacaaagtttgcagagaaattccaggaggtaagagaagctgccaggttagccagagacaagtcccaggagaaaatcgagacgtcaagtaatcattcccaagaatctgggtgtgaaaccccgtcttccactcaggcatccagcgtcaatgggacagatgacgagaaagcctcccatgcgagtccggccgacacacacctcaagtctgagaatgacaagctgaagatcgctttgacacagagtgctgccaatgtgaagaagtgggagatcgagctgcagaccctgcgggagagcaatgcccggctgaccaccgcgctgcaggagtcggcggccagtgtagaacagtggaagcggcaattctccatctgcagagatgagaatgacaggctccgcagcaagattgaggagctggaagaacagtgcggtgagatcaacagggagaaggaaaagaacacccagctgaagaggaggattgaggagctggagtcagaggtccgagaaaaggaaatggagttgaaggatctccgcaaacaaagtgaaatcatacctcagctcatgtccgagtgtgaatatgtctctgagaagttagaggctgcagaaagagacaatcaaaacttggaagacaaagtgcggtctctaaagacagacatcgaggagagtaaataccggcagcgccacctgaagggggagctcaagagcttccttgaggtgctggacggaaagatcgatgacctccacgacttccgccgagggctctccaagctaggcacggataactagggtggggcggagcctagatggagagtggaaagcgtgtgtgagagatgaagtgggcatagggcattctccgtttgcttctgtaatgcgggtgcgttctgtctgtctccaggccagtcgtgccgtccactcgctcctccagaatagaaaatctcttgcttctctggctttgtgaggtcgtggacacctggaagcttctgactcaggaatccagaacggtctaccttagccgtttacgcagtcagggcagggacattcagatcttcccttaagggctgttgcaaccctatgaactggggatgggggaagtattttctaatccaagtatcattaacctttacaacaggcctttgggcgccttccgctgcgtggcactcagtgtgtgagactctagattccagaccgggagcacgtggagggaacatcttttcccaggatgcattctgttcctttagcagaggtagctaacctttcgaagttatgacagatttcacactcaaaaactgcacaattgatctacccaaaaagaaataattatttaaaaaaaaaaacctaacatattttaagtaaatacactgttttgggttggagcgcattcatagttaccctcagctgcatgtggcctttggactgtaggccacacaaacctcgtgccgaatt

SEQ ID NO: 2369 - DNA, 1896 bp, Rattus norvegicus
  Genbank Accession No. NM_053326
ctgaggcggagggtgcgccgcgcgggtccggagaactgcacatcgaatccttcgaaccatgagcaactacaatgtgtcattggttggcccagctccttggggtttccggctccaaggtggcaaggatttcaacatgcctctgacaatctctagtctgaaagatggtggcaaggcatcacaggcacacgtcagaataggcgatgtggttctcagcattgatggaatcagtgcccagggaatgactcatctcgaagcgcagaacaagattaaggcttgtacaggctccttgaatatgactctgcaaagagcttctgctgctgccaagtctgagccagttgctgtccagaagggggaacctaaggaagtagttaagcctgtgcccattacatctcctgctgtatccaaagtcacttccacaaccaacatggcttacaataaagtgccacggccctttggctctgtgtcttcaccaaaagtcacatccatcccatcgccatcgtccgccttcaccccagcccatgccgccacgtcatcacacgcttcccctccacctgtggctgctgtcactccccctccactctctgcatccggactgcatgctagtgccaatcctagtgctgcccagtgttcgtctccaccaaacactggtaaacctgcagttcatgtcccacggcagcccacagtcaccagcgtgtgttccgagtctgctcaggagctagcagagggacagagaagaggatcccagggtgacattaaacagcaaaatggcccaccaagaaaacacatcgtggagcgcaacacggagttttatcacatacccactcacagtgatgccagcaagaaaaggctgattgaggacactgaggactggcgcccacggactggaacgacacagtctcgttccttccgaatcctcgcccagatcactgggactgagcatttgaaagaatctgagaatgacaatgcgaagaaggcaaatagcactccggagccttctcagcagtcagcttcacctctgagcgcggcggagagcctggagagcccaggttcaaacaggccagtggtggctggcctcaggtccgctgctgctttcaagcctgtaggatccaccagtgtcaagtcaccaagctggcagcgtccaaaccaagcagcaccttctactgggagaatttcaaacagtgcaagctcttcaggtacaggggcacccatgaagccagctgtggggccaccccagccaagtgaccaagacactcttgtgcagagagctgagcacattccggcgggcaagcggactcccatgtgtgcccactgcaaccaggccatcaggggaccttttctcgtggctctggggaagtcctggcatccagaagaattcaactgtgctcactgcaaaaacacgatggcctatataggctttgtggaggagaagggagcactgtattgtgagctatgttatgagaagttctttgctcctgaatgtggccggtgccagaggaagatccttggggaagtcatcaatgctttgaagcagacctggcacgtgtcctgttttgtgtgtgtggcctgtggaaaacccatccgtaataatgttttccacttggaagatggcgagccctactgtgagacagactattatgcactttttggaacaatatgtcgcgggtgtgaattccccatagaggctggtgacatgttcctggaagctctgggctccacctggcatgacacttgctttgtgtgctccgtgtgttgtgaaagtttggaagggcagacatttttctccaagaaggacaagccactttgcaaaaaacatgctcattctgtgaatttctgaaaatcaacagttccaggaaagagaagaaatttgaaaaaaaaaaaaaaaaaaaaaaaaaaaaa

SEQ ID NO: 2370 - DNA, 2388 bp, Rattus norvegicus
  Genbank Accession No. NM_053328
ttccctcccgcctctccacccgccccacttctcattcacttggctcgcacggcgcagacagccaggcgagcacacaccgccagtctgtgtgcagagcgggagccagaagccgtgggggacacccggtcatgcacgcccccaactgaagcgacacctcaaagccgcagctcctggcagcccaggccattgcaagaagctcaggctagctcataggaacataccccttgagaccctcggatcctcccttccaggccagtcctctctcagactctctgctaagtgcagacaggagcgcacagtggcccctgctcgccgcatcatggagcggatccccagcgcgcaaccacctcctacctgcctgcccaaaacgccagggctggagcacggagacctgtcagggatggattttgcccacatgtaccaagtgtacaagtccaggcggggaataaaacggagcgaggacagcaaggaaacttacaaattgccgcaccggttgattgagaaaaagagacgtgaccggattaacgagtgcattgcccagctgaaggatctcctacccgaacatctcaaacttactactttgggtcacttggagaaagcagtggttctcgagctgacgctgaagcacgtgaaagcattgacaaacctaattgatcagcagcagcagaaaatcatggccctgcagagcggtttacaagctggtgatctgtcgggaaagaatattgaggcaggacaagaaatgttctgctccggtttccagacctgtgcccgggaggtacttcagtacctggccaagcatgaaaacactagggacctgaagtcttcccagcttgtcactcatctccaccgtgtggtctctgaactcctgcagggtagtgcttccaggaaaccattggactcagctcccaaacccgtggacttcaaagagaagcccagcttcctagccaagggatcagaaggccctgggaaaaactgtgtgccagtcatccagaggacttttgctccctcgggcggggagcagagtggtagtgacacggacacagacagtggctacggaggcgaattggagaagggtgacttgcgcagtgagcaaccctacttcaagagcgatcacggacgcaggttcaccgtgggagaacgcgtcagcacaattaagcaagaatctgaagagccccccaccaaaaagagccgaatgcagctctcagatgaggaaggccacttcgtgggcagtgacctgatgggttccccatttcttgggcctcacccacatcagcctcccttttgcctgcccttctatctcatcccaccatcggccactgcctatctgcctatgctggagaaatgctggtatccgacctctgtgccactgttatacccaggcctcaacacctcagcagcagccctctccagcttcatgaacccagacaagatcccaactcccttgctcctgccccagagactcccttctcccttggcacattcgtcccttgactcttcagccttgctccaggccctgaagcagatccctcctttaaacttagaaaccaaagactaaactcttgagggcgaatctcctgctgctttgcttttcctttccccactaattccaagaccacaaaaggtttctgtgagtgcagagagatcggcccaccatgcagacccacagagaagattcagaatgtgtgtgagagtgagtgtgtgagtgcgcgtgcgtgtgcttgtatgtgtgtttatagatgtaggacattaagttccttctgacacagggaagatgtgagaaggatggcctgacatcagatgacaagaggtctatagcacatctctgggcttttccctacccagagaagagccccctttgatacaaatcagttggattttcatatgcttcaaaggcttgatctgtgagtcactccagtttgggacataggtctgtctgtggctttgagaaaaggtactttcaaaagagggctttccagagcacagctcacagccagctgttaggaccccacccttctcctttattgtggaggtgactcacagcagactgacagtggtcagactgagctttctgctaaggtggtgaggtagccaacactggcatgtctcggtagtggtttgggcaaatttccgcaggtctcttcccccaaccctgcctctgatgaataaagacaatgagtacagttccttaattcaggcttttgtgactagcttactacggaaccgaaaatggtcccctttgtacaagccgagctgttatggaatcacggtgaaccagacccaggtctgtggcacctgtttgtttgtttttttttttttttttttttagctctcatttctacggcatgctttccaaggaaccaaaggagggtctcagagatgccccctcgt

SEQ ID NO: 2371 - DNA, 554 bp, Rattus norvegicus
  Genbank Accession No. NM_053330
ctttccgccggggcagccatcttccagtaactcgccaaaatgacgaacacaaaaggaaagaggaggggtactcggtatatgttctctagaccttttaggaaacatggagtcgttcctttggccacatacatgcgaatctacaagaagggtgatattgtagacatcaagggaatgggcactgttcaaaaaggaatgccccataagtgttaccatggcaaaaccggaagagtctacaatgtcacccagcatgccgtgggcatcattgtgaacaagcaagttaaaggcaagattctggccaagaggatcaatgtgcggattgagcacatcaagcactcaaagagcagagacagcttcctgaagcgggtgaaggagaacgatcagaagaaaaaggaagccaaagagaagggcacctgggttcagcttaacggccagcctgcgccacccagagaagcccactttgtgaggactaacggaaaggagcctgagctgctggagcccattccatacgaattcatggcctaatgtatacaaaggaaataaagaacccgaactgc

SEQ ID NO: 2372 - DNA, 540 bp, Rattus norvegicus
  Genbank Accession No. NM_053333
ggcacgaggggacactgactttcaacaggatgaagactgcaacctgttcccttctcatctgcgtcttccttctccagctgatggtcccagtgaatactgatggaaccttagacattattgggaagaaaaaggtcaaggaacttctagcccatcaagataactatccctctgctgtaaggaagaccctctcatgcactaatgtcaagtctatgagcaaatgggcctcctgccctgctgggatgactgctactggttgttcttgtggctttgcctgtggatcttgggaaatccagaatgaaaatatttgcaactgcctgtgcttaatcgttgactgggcctatgcccgctgctgccaactgtcctaagaatggagaggcacagaactcagctttgatatgatgagtctaacaaaactgcaatctcaacttggaaatctgactcatgcgcatttgatgtattcatattgcccattaaccccgcttcttgaaaaaataaagacaaatttacatcttaaaaaaaaaaaaaaaaaaaaaaaaatgg

SEQ ID NO: 2373 - DNA, 1421 bp, Rattus norvegicus
  Genbank Accession No. NM_053338
aaggttgcagacgtgacagagacaaggctccgagtctgaacaggggtctgcgagtgggtctatctgattccccagtggtctgtgccgcagcgctgatcaagtgctgatagcatctgtgcaagagtcgacggcgattccgacacgatgaccctgaatggaggcagcggagcgggcggcagccgtagcgcgggccgggagcgcgaccgtcgtcgaggcagcaccccatggggcccggcacccccactgcaccgcaggagcatgccggtggacgagcgagaccttcaggcggcgctaaccccgggctccctggcagcgactgcagctggaactcggacacaggggcagaggctggactggcctgaaggctcctccgattcgctcagttctggagacagcggctcagaggatggcgtttacaaggtgcatgctgctggggcgcctggtgtgggcaagagtgctctggcgcgcatctttggtggagtagaagacggacctgaagcagaagctgcagggcacacatatgaccgttctatcactgtggatggagaagaagcatcactaatggtctatgacatttgggaacaggatggaggctgctggctgcctggccactgcatggccatgggggatgcatatgtcattgtgtactcaataacggacaagggcagctttgagaaagcctcagaactccgggtccagctgcgcgcacgcagacagacagatgtgcccatcatcctagtgggcaacaagagcgatcttgtgcgctctcgtgaggtctctgtggatgagggccgggcttgcgcagaggtcttcgactgcaagttcatcgagacctccgcagcactgcatcacaacgtccaggcactgttcgagggtgttgtgcgtcagatacgcctgcgcagggacagcaaagaggataatgctcgtcgacaagctggcactcgacgacgggagagccttggcaagaaggccaaactctttctgggccgcatagtagctcgcaacagccgcaagatggcctttctggccaagtccaagtcctgccatgacctctctgttctctaagcccaacggcccccttgtttgtgggtcagcagatggatggaaggctgcccagccaactgctctaaatgtctcagagttggcccaccctccggtatttctcagaactgtcaactatgcacagcctgtctcacggtcatggacagatagtgctgaccagggaggcaactccaaacgccatcgagcctgggcctatggagatgcatgtgcaggcccacgtgcataccgagcagcctgaaccctgctcttggacaggactctgcctttctccatgtgggtgtctgcctggagggaggctgttctatatgcttgctgtttgtttacatgcagctttttgtaataaagactatttcctgaca

SEQ ID NO: 2374 - DNA, 330 bp, Rattus norvegicus
  Genbank Accession No. NM_053345
atggcatatcagttatacagaaatacaactttggggaacagtcttcaagagagccttgatgagctcatacagtctcaacagatcaccccccagcttgcccttcaagttctacttcagtttgataaagctataaattcagcattggctcagagagtcaggaacagagtcaatttcaggggctctctaaatacatacagattctgcgataatgtttggacttttgtattgaatgatgttgaattcagagaggtgacagaacttattaaagtggataaagtgaaaattgtagcctgtgatggtaaaaataccggttccaataccacggaatga

SEQ ID NO: 2375 - DNA, 2153 bp, Rattus norvegicus
  Genbank Accession No. NM_053347
atggaggactcgggaaagacttttggatcagaggaggaagaaacaaactattggagagacctggccatgacctacaagcagagggcagagaatactcaggaggaactccgagaattccaggaaggaagccgggaatatgaagctgaattggagactcagctgcagcaagctgaaaccagaaaccgggacctattatcagagaataaccgccttcgaatggagctggagtctgtgaaggagaagtttgaaatgcagcattcagagggttaccggcagatctcggccttggaggatgacctggctcatacaaaagccattaaagaccaactgcagaaatacatcagggagctggaacaagccaatgatgacctggaaagagccaaacgagccacaatcatgtccctggaagactttgagcagcgtttgaatcaagccattgaaagaaatgccttcctagagagtgagctggatgagaaggaaaatcttctagaatctgtgcagagactgaaggatgaagctcgagatcttcggcaggaattggctgtgcagcagaagcaagacaagccccggacacccatgcccagctcaggggaaaccaaaaggacagacatggctgtacaggccacaggctctgcaccatctactccaataactcaccaaggatccagctctggtttgaacacaccagaaacgttcagatgtggcctgggcagtcccagtagtggaaccccactcacacctgcagcccggatatcagccttaaacatcgttggggacctgcttcggaaagttggggccctggagtccaaactagcatcatgcaagaacttcatgtatgatcagtccccaagccggaaaagcgggccagccttgggccgaggaaccaaaaacagagacggtattgacagaaggccaggcagcaccgctgtgggcgataaagggtcaggaaaacgcttggagtttgcgaagccgtcctcacagctctcatcaccagcgctgccatccacccagggtgtggtcaagcttttgctttaggaccagtgggaactgcgccctcacctatcttccctactttatagtcagcttttagttatttttttttcaaggtaatttgagaaataagagaccacatcaccagcatttactttgtgctatgcagcctaagctaaggctgtgtgtggcccagtccctagcagtggatgtcactaaaatgagctccccaaccccaaccaggcagctctaaggtatgatttcattgactacctagagttttaatagcctccagaggtgctttgaatatgcgtaatcttcagagcaggactaaagcccagctcaggagctctctgcagcctacttccagctgaagctatattctggaacatttcctggtgcttttaaagcatgattaaattttatctaggactgggagactacagaggcaaaaggctatatttaaaccatctgctaaaagtactactcatgtacctttgacacttcaacactgttggcctcataggtcagtgggaggttatcctctacagataaaccctgactcgtgtctctcctgagtcccctgccctggtgttgggagtggcatgtgcatcaggaccctggacagcttgcgttggactggcctttgttacaccatccctaagaacagaacttcatctagcagcttcttccagacaccacagagcaaccagggtgactgaagcacgagatggagattaccaccagctgctccatcggatgtggaaaaatcagcacaggctctacaatgccagctcgcctcatctctggtgtgtgatgcttgctgcctcacacttcgatccacaatgagaaaagcacacttatactagagcgtgacaccctccacttggctactaacttatttcctagttgatgagcaaaactggcctagcatcagacctagaactttgtgtgtgctactgacattcacagggtgattttaagctgcttggttatttgttctccttagacataataactggggaaagatgaactttattttttataaaaaataaaaccaaaagaaatgcctgttcaatagatgtgtgtgtcagtccttccatgtctgtgcacgtggccatgaagtttgttttgttcaaccaagtaattaaatatttgaaccc

SEQ ID NO: 2376 - DNA, 4474 bp, Rattus norvegicus
  Genbank Accession No. NM_053356
atgctcagctttgtggatacgcggactctgttgctgcttgcagtaacgtcgtgcctagcaacatgccaatctttacaaatgggatctgtacggaagggccccactggagacagaggaccgcgtggacaaaggggcccagcaggtccccgaggcagagatggtgttgatggtcccgttggccctcctggtccccctggtgcccctggcccccctggtccccctggcccccctggtcttactgggaactttgctgctcagtattctgacaaaggagtttcagctggccccggaccaatgggcttaatgggacccagaggccctcctggtgctgtcggagcccctggccctcaaggtttccaaggacctgctggtgagcctggtgagcccggacaaacgggtcctgcaggttcccgtgggccagctggccctcctggcaaggccggtgaagatggtcaccctggaaaacctggaagacctggcgagagaggagtcgttgggccacaaggtgctcgtggtttccctgggactcctggacttcctggcttcaaaggcattcgaggacacaacggtctggatggattgaaaggacagcctggtgcccagggtgtgaagggtgaacccggtgcccctggagagaatggaaccccaggtcaagcaggagcccgagggcttcctggtgagagagggcgtgtcggagctcctggtccagctggtgcccgtggcagtgatggcagtgttggccccgtcggccctgctggtcccattgggtctgctggtcctcctggtttcccaggtgctcctggtcccaagggtgaacttgggcctgttggtaaccctggccctgctggtcctgctggtccccgtggtgaagcgggtcttccgggtctttctggccccgttggacctcctggcaaccctggagcaaatggcctcactggtgccaagggagccactggactccctggtgttgctggggctcctggtctccccggtccccgtggtattcctggccccgttggtgctgctggtgccactggtcccagaggacttgttggtgaacctggtcctgctggctccaaaggagagactggtaacaagggtgagcctggctctgctggagcccaaggtcctcctggtcccagcggtgaagaaggaaagagagggtcccctggagagcctggatctgctggtcctgcagggcctccagggctgagaggcagccctggttctcgaggtcttcctggagctgatggcagagctggtgtgatgggccctcctggcaatcgtggttcaactggccctgctggagtccgaggtcctaatggagatgccggtcgccctggagaacctggtctcatgggacccagaggtcttcccgggtctcctggaaatgttggcccagctggtaaagaaggccctgtgggtctccctggcatcgatggcagacctggcccaattggcccagctggaccaagaggtgaagctggcaacatcggattccctggacccaaaggcccctctggtgatcctggcaaacctggtgagaaaggccatcccggtctcgctggtgctcggggagctccaggtcccgacggcaacaatggtgctcagggccctcctggacctcagggtgttcaaggtggcaaaggtgaacagggccctgctggtcctccaggcttccagggtctcccgggtccctctggtaccgctggagaagttggcaagccgggagaaaggggtcttcccggtgaattcggtctccctggtcctgctggtccaagaggagaacgtggtcccccaggtgagagtggagctgctggtccttctggtcctattggaatccgaggtccctctggagccccagggcctgatgggaacaagggtgaagctggtgcagtcggtgctccaggctctgctggtgcctctggtcctggtgggcttccaggagagaggggtgctgctggcatacctggaggcaaaggagaaaagggtgaaactggtctcagaggtgaaatcggcaaccctggtagagatggtgctcgaggtgctcctggtgctataggtgcccctggtcccgctggagcctcaggtgaccggggcgaagctggtgctgctggtccttctggccctgctggtcctcgaggtagccctggtgaacgtggtgaggttggtcctgctggccccaatggatttgctggtcctgctggttctgctggccaacctggtgctaaaggagaaaagggaaccaaagggcctaagggagaaaatggcatcgttggtccaaccggacctgtcggagctgctggcccatctggtcctaatggcccacctggccctgctggaagtcgtggtgatggagggccccctggtatgactggcttccctggtgctgctggacggactggtccccccggacccagtggtattactggcccccctggtccccctggtgctgctggtaaagaaggtattcgtggtccccgtggtgaccaaggtccagttggccgaactggagaaataggtgcatctggtccccctggatttgctggcgagaagggtccttctggagaacctggtaccacaggaccccctggcactgcaggtcctcagggtcttcttggtgctcccggtattctgggtctccctggctctcgaggtgaacgtggccagccaggtattgctggtgctctgggtgaacctggtcctctgggcattgcaggccctcctggggcccgtggtccccctggtgctgtgggcagtcctggagttaatggtgcccctggtgaagccggtcgtgatggtaaccctggcagtgatggtcccccaggtcgtgatggtcaacccggacacaagggagagcgtggttaccctggcaacattggtcccactggtgctgcaggtgctcctggtcctcatggttctgtgggtcctgctgggaaacatggaaaccgtggtgagcctggtcctgctggttctgttggtcccgttggtgctgtcggtccaagaggtcctagtggccctcaaggtattcgaggtgacaagggagagcctggtgacaaaggggccagaggtcttcctggcttaaaaggacacaatggattacagggtcttcctggtcttgctgggctgcatggtgaccaaggagctcctggtcccgtgggtcctgctggtcccaggggtcctgctggtccttctggccccattggcaaagatggtagatctggacatcctggaccagtcggtcctgctggcgttcgtggctctcagggtagccaaggtcccgctggtccccctggtccccctgggcctcctgggcctcctggtgtcagcggaggaggctatgactttggtttcgaaggaggcttctacagggctgaccagcctcgctcacagccttcactcagacccaaggactatgaagttgatgcaactctgaaatctctcaataaccaaatcgagacccttctcactcctgaaggctctagaaagaaccctgcccgcacatgccgtgacttaagactcagccacccagagtggaagagcgattactactggattgaccctaaccaaggatgcactatggatgccatcaaagtgtactgcgatttctctactggtgaaacctgcatccaggcccaacctgtcaacaccccagccaagaatgcatacagccgtgcccaggccaacaagcatgtctggttaggagagaccatcaatggtggcagccagtttgaatacaacgcagaaggggtgtcctccaaggaaatggcaactcagctcgccttcatgcgcctgctagccaaccgtgcttctcagaacatcacctaccactgcaagaacagcattgcgtacctggacgaggagacaggccgcctgaataaggctgtcattctgcagggctccaacgacgtcgaacttgttgctgagggcaacagcagattcacctacactgtccttgtcgatggctgctccaaaaagacaaatgaatgggacaagacagtcattgaatacaaaacgaataagccatctcgcctgccattccttgacattgcacctctggacatcggtggtactaaccaagaattccgtgtggaggttggccctgtctgtttcaaataagtgaactcaacctaaattaaaaaacaaaaacccctgaaaaaaactttctctttgccatttcttcctttaaaaaaaaaaaaaaaactgaaagctgaatccttccgtgttttctatgcacctacatcttaaactgtgggcaaaagagaaggattggtcagagcagtgtgcaatatgatccagataagtcccctccctcaggccctccccaaaacgtttgcagtgttatttctgtgggtttttttttaaacactctgacacctgttgtggacattgtcaacctctgtaagaaaacccaaataaaattttaaaaataaaataaaaagaaacccatgaacatttgcaccaaaaaaaaaaa

SEQ ID NO: 2377 - DNA, 600 bp, Rattus norvegicus
  Genbank Accession No. NM_053365
  misc_feature (1)..(600): n = a or c or g or t
cttaggnaccctgctagcaganaattcggcacgagtccttgaaagcttacaaaatgtgcgacgcctttgtggggacctggaaactcgtctccagtgagaacttcgatgattacatgaaagaagtgggagttggcttcgccaccaggaaagtggccggtatggccaagcccaacttgatcatcagcgtagaaggggacttggtcgtcatccggtcagagagtacttttaaaaacaccgagatttccttcaaactgggcgtggaattcgatgaaatcaccccagatgacaggaaagtgaagagcatcataaccctggatggtggggtcctggtacatgtgcagaagtgggatggaaagtcgaccaccataaagaggagacnagatggtgacaagctggtggtggaatgtgtcatgaaaggcgtgacttctacaagagtttacnaaagggcatnagccaagggacgaggccctggactgaaatttgcatcaaactctacaataacttgatgggatttggtggttttgntatttntttttttaagatcnattttgcactaattagcaagcaatcactttnttcttgaactgggaatttattgga

SEQ ID NO: 2378 - DNA, 2059 bp, Rattus norvegicus
  Genbank Accession No. NM_053369
gcacgagtacgggctcaaatgtagaagacagaagtagctcagggtcctgggggaatggaggtcatccaagcccgtccaggaactatggagatgggactccctatgaccacatgactagcagggatcttgggtcacatgacaatctctctccaccttttgccaattccagaatacaaagtaaaacagaaaggggttcatactcatcttatgggagagaaaacgtacagggttgccaccagagtctcctcggaggggacatggatatgggcaacccaggaaccctttcgcccaccaaacctggctcccagtactacccatattccagcaataacgcccgacggaggcctcttcacagtagtaccatggaggtgcagacaaagaaagtcagaaaagttcctccaggcttgccatcttcagtctacgctccttcagccagcactgccgactacaacagggactcaccaggctattcttcctccaagccagcagccagcactttctccagctccttcttcatgcaagatggccatcacagcagtgacccttggagctcctccagtggaatgaatcagcccggctatggagggatgctaggcaactctcatatcccacagtctagcagctactgtagcctgcatccacatgaacgtctgagctatccatcgcactcctcggcagacatcaactccagtcttcctccgatgtccacgttccatcgaagtggcacaaaccattacagcacctcttcctgcacacctcctgccaacggaacagacagtataatggcaaacagaggaactggggcagcaggcagctcccagactggagacgctctggggaaagccctggcttcgatctattctcctgatcacacgaacaacagcttctcctccaacccttcaactcctgttggctcccctccttcactctcagcaggcacagctgtttggtctcgaaacggaggacaggcctcgtcatctcccaattacgaaggacccttgcactccttgcagagccgaattgaagaccgtttagaaagactggacgacgcaattcatgttctccggaaccacgcggtgggcccatccacagctgtgcccggtggccatggggacatgcatgggatcatcggaccctctcacaatggagcaatgggcagtctgggctcaggatatggaactggccttctctcagccaacagacattcactcatggtcggggcccaccgtgaagatggcgtggcactgagaggcagccattctctcctgccaaaccaggttccggttccacagcttccggtccagtctgcaacttcccctgacttgaacccaccccaagacccttacagagggatgccaccaggcctccagggacagagtgtgtcttccggcagctctgagatcaagtccgacgacgagggcgatgagaacctacaggacacaaaatcttccgaggacaagaaactagacgacgacaagaaggatatcaaatcaattactagcaataacgatgatgaggacctgaccccggagcagaaggccgagcgtgagaaggagcggaggatggccaataacgcccgtgagcgcctgagggtccgtgatatcaacgaggctttcaaggagctgggccgcatggtacagctccacctgaagagcgacaagccccagaccaagctcctgattctccaccaggcagtggctgtcatcctcagcctggagcagcaagtgcgagaaaggaacctgaacccaaaagctgcctgtctgaaaagaagggaggaagagaaggtgtcctcagagcctcccccgctctccttggctggcccacaccctgggatgggagacacagcgaatcacatgggtcagatgtgaaagggtccaagttgccaccttgcttcattaaaacaagagaccacttccttaacagctgtattatcctaaacccacataaacactgctccttaaccccgttttttttgtaatataagacaagtctgagtagttatgaatcgcagacgcaagaggtttcagcattcccaattatcaaaaaaaaaaaaaaaaaa

SEQ ID NO: 2379 - DNA, 519 bp, Rattus norvegicus
  Genbank Accession No. NM_053401
aggaggactacgcggcaagggataggcccaggaaaacgaagaaatggagcagcccctgcagaatggacaggaagaccgccccgtgggaggaggtgagggccaccagcctgctgcaaacaacaacaaccacaaccataaccacaaccacaaccacaaccacaaccacaatcatcaccggagaggacaggcccgccgacttgcccctaactttcgatgggccattcccaacaggcagatgaatgatgggttgggtggagatggagatgatatggaaatgttcatggaggagatgagagagatccggagaaagcttagggagctgcagttgagaaattgtctgcgtattcttatgggggagctctctaatcaccacgaccatcacgatgaattctgccttatgccttgacttcggtcatttcccctgagattcatactgtgattcccgctgtattcctagcccttgcattttcctgacatgcctttaaatgacccgttttgtggtgagccttggtgttattt

SEQ ID NO: 2380 - DNA, 1751 bp, Rattus norvegicus
  Genbank Accession No. NM_053437
gaagattgggccgcgacgaggtgcgggccgaagccatgggcgaccgcggaggcgcgggaagctctcggcgtcgcaggaccggctcgcgggtttccgtccagggaggtagtgggcccaaggtagaagaggacgaggtgcgagaagcggctgtgagccccgacttgggcgccgggggtgacgcgccggctccggctccggctccagcccatacccgggacaaagaccggcagaccagcgtgggcgacggccactgggagctgaggtgccatcgtctgcaagactctttgttcagctcagacagcggtttcagcaattaccgtggtatcctgaattggtgcgtggtgatgctgatcctgagtaatgcaaggttatctttagagaatcttatcaagtatggcatcctggtggatcccatccaggtggtgtctctgtttctgaaggacccctacagctggcctgccccatgcttgatcattgcatccaatatctttattgtggctacatttcagattgagaagcgcctgtcagtgggtgccctgacagagcagatggggctgctgctacatgtggttaacctggccacaattatctgcttcccagcagctgtggccttactggttgagtctatcactccagtgggttccctgtttgctctggcatcatactccatcatcttcctcaagctttcttcctaccgggatgtcaatctgtggtgccgccagcgaagggtcaaggccaaagctgtgtctgcagggaagaaggtcagtggggctgctgcccagaacactgtaagctatccggacaacctgacctaccgagatctctattacttcatctttgctcctactttgtgttatgaactcaactttcctcgatccccccgaatacgaaagcgctttctgctacggcgggttcttgagatgctctttttcacccagcttcaagtggggctgatccagcagtggatggtccctactatccagaactccatgaagcccttcaaggacatggactattcacgaatcattgagcgtctcttaaagctggcggtccccaaccatctgatatggctcatcttcttctattggcttttccactcatgtctcaatgctgtggcagagctcctgcagtttggagaccgcgagttctacagggactggtggaatgctgagtctgtcacctacttttggcagaactggaatatccccgtgcacaagtggtgcatcagacacttttacaagcctatgctcagactgggcagcaacaaatggatggccaggactggggtcttttgggcgtcagctttctttcatgagtacctagtgagcattcccctgaggatgttccgcctttgggcattcacagcaatgatggctcaggtcccactggcctggattgtgaaccgcttcttccaagggaactatggcaatgcagctgtgtgggtgacactcatcattgggcaaccggtggctgtgctcatgtatgtccacgactactacgtgctcaactatgatgccccagtgggggcatgagctactgccaaaggccagcctccctaacctgggcctggagttctggagggcttcctgctgctgcacactcccctagtttggaggcctttctgcccctatggggcctactcctgctcttggggatggccctgagccagctggttgagccagtgctgggagtttgtgctgaccaggggcttaggatatcaataaagagctatctaaaaaaaaaaaaaaaaa

SEQ ID NO: 2381 - DNA, 1799 bp, Rattus norvegicus
  Genbank Accession No. NM_053448
  misc_feature (1)..(1799): n = a or c or g or t
gggcggcgggcgggcggctgagtcggggcctggtcccccagcaccatggccaagaccgtggcgtatttctacgaccccgatgtgggcaacttccactacggagctggacacccgatgaaaccccatcgcctggcattgactcatagcctagtcctgcattatggtctctataagaagatgatcgtcttcaagccttaccaggcctcccagcatgacatgtgccgcttccattctgaggactacattgacttcctgcagagagtcagccccaccaatatgcagggtttcaccaagagccttaatgccttcaacgtgggtgacgactgccctgtgtttcccgggctcttcgagttctgctcccgctatacaggcgcatctctgcaaggggcaacacagctaaacaataagatctgtgatattgccatcaactgggctggtggtctacatcatgccaagaagtttgaggcctctggcttctgctatgtcaatgacatagtaattggtatcctggagctgctcaagtaccaccctcgggtgctgtacattgatattgacatccaccatggtgacggggttcaggaagccttctacctcactgaccgggtcatgactgtgtccttccacaaatatggaaattacttctttcctggaacaggtgatatgtatgaagttggagcagagagtggccgctactattgtctcaatgtgcccttacgggatggcattgatgaccagagttacaagcaccttttccagccggtcatcagccaggtggtggacttctatcagccganctgcatcgtgctgcagtgtggcgctgactccctgggctgtgatcgattaggctgcttcaatctcagcattcgaggacatggggaatgtgttgaatatgtcaagagtttcaatatccctctcctggtgctgggaggtggtggttacaccgtccgaaatgttgcccggtgctggacatatgaaacatctctgctggtagaagaggccattagtgaggaacttccctatagtgaatacttcgagtactttgccccagatttcacgctccatccagatgtcagcacccgcatcgagaatcagaactcacgccagtatctagaccagatccgccagaccatctttgaaaacttgaagatgctgaaccatgcacccagtgtccagattcatgatgttccagcagatctcctgacctatgacaggactgacgaggccgatgctgaagagaggggtcctgaggagaactacagcaggccagaagcacccaatgaattctatgatggagaccatgacaatgacaaggaaagcgatgtggagatttaagagcagcatggatgccgtgtccccaagagttccttgtcacctctgtggtgggaaggaaagtattgctctcccaggtctgaactgggtatccccagggtgtttactaactctggtaacgggtttggaaaccacatctggttctagagtcaactaccccctttcctcaaactctcatatacccgatggacaggtctctggaacattatgggtaatgagccctagcagctgaccccagcccctcttccccttatttgttcctctgtccttccagcacagagactgttagagatgaaagtctggacggtactaaggtcccctctgacttccttctgggttctctactgcagttcttgcttccatgcaaggtgaacctgaggggaggaaggcatgccaaccggctttatgtccattttactgtttttgatcntaataaaccaattggtattttttgtaaaaaaaaaaaaaaa

SEQ ID NO: 2382 - DNA, 2303 bp, Rattus norvegicus
  Genbank Accession No. NM_053463
cgatgcctacctctgtgccccgcggggcgcctttccttctcctaccacctttactgatgctgtctgctgtgctggcagtgcctgtggaccgcgcagcacctcatcaggaggacaaccaggccactgagaccccggacacaggcctgtactaccatcggtacctccaggaggtcatcaacgtgctagagacagatgggcacttccgggagaagctgcaagctgccaacgctgaggacattaagagtggaaagctgagtcaagagctggacttcgtcagccacaacgtccgcaccaagctggatgagctcaagcgacaggaggtatcaaggcttcggatgctgctcaaggccaagatggatgcaaagcaggagcctaacttgcaggtggaccacatgaaccttctgaagcagtttgaacacctggaccctcagaaccagcacacgtttgaggctcgggacctagagctgctgatccagacggccacccgagacctcgcccagtatgacgctgcacaccatgaagagttcaaacgctacgagatgctcaaggaacatgagcgaagacgttacctggagtctctgggagaggagcagcggaaggaggctgagaggaagctacaagagcagcagcgcagacaccgggaacaccccaaagtcaatgttcctggcagccaagcccagttgaaggaggtgtgggaggagctagatggattggaccccaacaggttcaaccccaagaccttcttcatactgcatgacatcaacagcgatggtgtcctagatgagcaagaactggaagctctgtttaccaaggagctggagaaggtgtacgacccgaagaacgaggaggacgacatgagggagatggaggaggagcggctgcgcatgcgggagcatgtgatgaagaacgtggacaccaaccaggaccgacttgtgaccctggaggaattcctggcatccacacagaggaaggagtttggggaaactgcggagggatggaagacagtggaaatgtatccagcctacacagaggaagagctgaagcgttttgaagaggagcttgctgcccgggaggctgagctaaatgccagagcccagcgcctcagccaggagacagaggccctggggcgctcccaggaccgcctagaggctcagaagagagagctgcagcaggccgttctgcagatggagcaaaggaagcagcaacagcaagagcagagcgctccgccttcccaacctgatgggcagctgcagttccgtgcagacacaggggatgctcctgtcccagctccagcaggtgaccagaaagacgtgcctgcttctgaaaagaaggttccagagcagccccctgtgctgccacagctggattctcagcatttataagccctcagagatcccggccctcaagttcccacagacagtgatggaagctggatgaagtgtccttgcagcctttctggagaccaaagccttcatggcctccaggggagaacagggccaccctgttcctcagatgcgcttctgcccatgtctaccagtctgttctcacagcctctgggtcccagtcctgccttcctccctcccttccttggcagggactcaactgcaggagcccctcaccccacctgagtgcacaccccaggcctgcctgccttccatgctttgctcttacctgtcccaggctcaacctttctgcttcctgtacctgtcagtgggtcacaggagcttgacttggtctctccaactctttgccttgtgagaggccaatgatctcaattccttttggtggctagaggccgccacaatgtggggtgtcctatcagctctgcctgggactcctgaactccaccaccaccccaccagccttaccctaaccacctgggcccaatacctacctgagggtcccagaaggggcccagatatggctacaccccttactgaggtccagcctcactcagccccctatgggggctcctgaaaattggttcacccacttccctggcttcaggccacactgctgtgtcctgctctgtgtcccagtctcatccaactatagcctggcacaaataaacattagcatatctgtgtgaatgtactgccctcttgcaagtccccctgcatgccacctgctcgactccctggtgtcctgtggcacatacttccactgccaggaggcttgccgggggctttctgtgtgctcttgccagaatggcctccttgcttcatttttgccatggaaacagaaaacccaaacctgagcttgaaaaaaaattaatatcttaaataattaaaatatatatatgt

SEQ ID NO: 2383 - DNA, 704 bp, Rattus norvegicus
  Genbank Accession No. NM_053472
ccgccgtcttcagcttgcaactatgttttccagagctacccggagtctggtaatgaagacaggaggactcagaactcaagggacacacagcccaggaagtgctgctagcagcagccagcggaggatgaccccctatgttgactgctatgctcagcgctcctatcccatgccggatgagccttactgcacagagctcagcgaggagcagcgggccctgaaggagaaagagaagggcagctgggctcagctgagccaagcagagaaggtggccttgtaccggctccagttccacgagaccttcgcagagatgaaccatcgctccaacgaatggaagacagtaatgggctgcgtcttcttcttcattggattcacggctctggtgatttggtggcagcgggtctatgtgttccctaagaaggttgtcaccctgacggaagaacggaaagcccagcagctccagcgcctcctggacatgaagagcaaccccatacagggcctgtctgcccactgggattacgagaagaaagagtggaaaaagtgaccaacatcacagtctgctgcctgcccttgcaaaccgattccgcttccgcagcctaggagaccctcctctcctctcttctcctcccttcccctcccccacctcctgtcttgtctcctccattcccttctgctccaataaaagcagcctgcattgttctgcctgc

SEQ ID NO: 2384 - DNA, 4505 bp, Rattus norvegicus
  Genbank Accession No. NM_053474
ggggagggagggagggagggaggtgcggcggagcggcccgggttagcggagcagccacgggcgcggggatgccgggcatcccgagagccaaggcccccggccggagtagggggcgcctgcgccgccagcgccgctgacaccgcctcggaggatgtgagccggtgccgcggccgctgcttcgcgggctgggcgcgcggtcccagcggctccagccagcctccgcttctttaatttgggtgggggcgaacgcaccaggccgctagatctttggaagggggctggctgtctttggcagcttggttgggggaggcgacccacacagggcgctcggagattttttttttttaaagcagggttaactgttttttggcagcttgatttctgggggactctatagaaggcctttcgggatttctttctttggggggagggggcggtggtcccgacttggccagccgcctgctggagggggacagcggggagcagggggatgcgaacccggctcccccaaccatgatgaagacggagcctcgggggcccgggggtcccctccggagcgcctccccgcaccgcagcgcctacgaagcgggcatccaggcactaaagcctcccgatgctcccgggcctgacgaggcacccaaggcggcccaccataagaaatatggctccaacgtccaccgcatcaaaagtatgttcctgcagatgggcaccaccacggggccgccgggtgaggcaggcggcgcctcaggcatggccgaagccccacgggcgtccgatcgcggcgtgcgcctttccctgccgcgggccagcagcctgaacgagaacgtggaccacagtgccctgctcaagctgggcaccagtgtgtcggagcgcgtgagccgtttcgactccaagcccgcgccctcggcgcagccggctccgccgccgcacccgccgtcccggctgcaggagacgcggaagctgttcgaacggagcgtccccgcggcctcgggtggcgacaaggaggccgtggcgcggcggctgctgaggcaggagcgcgccagcctgcaggaccggaagctggacgtcgtggtgcgctttaacggcagcaccgaggcgctggacaagctggatgctgacgccgtgtcgccgacggtcagccagctcagtgcggtcttcgagaaagccgactcgaggaccggccttcaccgtgcacccggtccccctcgggccgcgggggcgccccaggtcaactcgaagctggtcaccaagcggtcccgggtgttccagccaccgccgccgcctcccgccccgtcgggggatgccgcgacagagaaggatcgtggccccggagggcagcagcccccacagcaccgagtggcccctgcccgacctccgccaaagccgcgggaggtacgcaagatcaaaccggtggaggttgaggaaagtggggagtctgaggctgagtcggctcccggggaagtgatccaggccgaggtgaccgtccatgcagccttggagaatggcagcaccacagccaccacagccagccctgcacccgaggaacccaaggccgaagcggtccccgaagaggaggcgtcgtcgtcagtggcgacactagagaggggggtggacaatggccgggccccggacatggcacccgaggaggtggatgaatccaaaaaggaggacttctcagaagcggacttggtagacgtgagcgcctacagtggactcggggaggactctgggggcagtgccctggaagaggacgatgaagaagatgaagaggacggggagcccccctacgagccggaatcagggtgtgtggagattcctgggctttcagaggaagaggacccagccccgagccggaagatccatttcagcaccgcaccgatccaagtattcagcacctactccaatgaggactatgaccgacgcaatgaggatgtggaccccatggcggcctctgcggaatacgagctggagaagcgagtggagaggttggagctgtttcctgtggagttggagaaggactctgagggcctgggcatcagcatcattggcatgggagccggagccgacatgggcctggagaagctgggcatcttcgtcaagactgtgactgagggtggtgcagcccatcgggatggcaggatccaagtgaacgatctcctggtagaggtggacgggacgagcctggtgggagtgacccagagctttgcagcctctgtgcttaggaacaccaaaggcagagtgcggttcatgattggccgggagcggcctggagaacagagtgaagtggcccagctaattcagcagaccttggagcaggagaggtggcagcgggagatgatggagcagagatacgcccagtatggagaagacgatgaggagacaggagagtatgccaccgatgaagatgaagaactgagcccgacatttccagggggtgaaatggccatcgaggtgtttgaactagcagagaatgaggatgcactgtcccctgtggagatggagcctgaaaagctggtgcacaagttcaaggagctccagatcaagcatgctgtcactgaagcggaaatccagcagctgaagcggaagttgcagagtctggagcaggagaaagggcgctggcgggtggagaaggcccagctggagcagagtgtggaggagaataaggagcggatggagaagctagaaggctactggggtgaggcccagagcctgtgccaggctgtggatgagcacctgcgggagactcaggcccagtatcaggccctggagcgaaagtacagcaaggccaagcgtctcatcaaggactaccagcaaaaggagatcgagttcctgaaaaaagagaccgcccagcgtcgggtactggaagagtcggagctagccaggaaggaggaaatggacaaacttctggataagatctcagaactggaaggaaacctgcaaacactgaggaattccaattctacttaacaggaatccttgactggacaatgataacccctccattatccttaccccctgtcctcaatcctcaccccacccctaccagcctggggacaggtgccccgacttcccctactcctccaccccatctcccccagcttcagggaccagagggcccatattacaggcccctttagggtggccagggcagacaatgctggctggaagagtggcctccttgccctgtggggctgaggcacagaggccgagagaagctaagagctggcctgggtggtggatggacacaaggacctgcagaccaaactgccagactttataacctccagcctgtgtctctggaccggagtggagctggggctctcccagcatctcaccacttggaggctgctccctgcccacagggtccgtatggcccctgggcctcttgacttgagattcttggccccttcctcttccccatcattgtgctgtctgttgcattctggcctccaacttggagggattgcctcaacatctcccacccctgctccccatcccaggagggatagagcccacccttgagccggaggctgggcctggtcctgcactgatatctctcctatccttcaggggggaaggagaatgtgactaggggaaagggtagtccaggacacctggaatccagccccccttcctaggaagggcagcagccctcaacttctccgtgtgcctcccctctcccaggtgccaaacagccataggcctcctcctggaactgccctgaggccactctggggttgggggtttccttggtctagcctaggaatgccaggagggagggaggtcagcttaggtggtgtgcctgcagagctctcactggagagctaggccctacccagggccacacccggaagccttgtattaacatcaaagagactcagcctcccctcctccactcccccactgttttccaatgttttcactggagggcaaaattttactactcatctttctggagaccagggctgcttactgtcagcctgctttctaagtgaaattgactccatttccccacgttaaccccaaattggggcttggaccaagggaggtgagaaccctcaggtaccctcccctttcagaatccatctcttgccacttccacataccaccccggccctaagcctaactttgttttattttttttttcttctttttaaaacaacccagttctatccttttcggtttctcctagtcccctgtaaatagaccataccatcaatcagtatttcttgcccctctcttcctcccctcgacgtgcccctactcccccgaaagagctggctgtcacagtgcccggcccctgcacttcacccaggcagatggagggggcggagccgggtgggcgggccctcggtgtacttccggttttgaccggcagcgctcctgccccgcccttggaggacccgtctctgtatataatatatatatgtatgtattgttcctggttttgtacggaccatgccctctgtcaggtcgtccccataaaagcagcccccagagaaaaa

SEQ ID NO: 2385 - DNA, 1886 bp, Rattus norvegicus
  Genbank Accession No. NM_053483
tctgcagcaaccatgtccaccaatgagaatgctaactcaacagctgcccggcttaacagattcaagaacaaggggaaagacagtacagaaatgcggcgccgccgaatagaggttaatgtggaacttaggaaagctaaaaaagatgaccagatgctgaaaaggaggaatgtcagctcattccctgatgacgctacttctccactacaggaaaaccgaaacaaccagggtactgtaaattggtctgttgaggacattgttaaaggcataaacagtaacaatttggaaagccagctccaagctactcaagctgctcggaaactgctttcaagagagaagcagcctcctatagacaacatcatccgggctggtttgatcccaaaatttgtgtccttcttgggcaaaacggattgtagtcccattcagtttgaatctgcttgggcgctcaccaacattgcttctggaacatccgaacagaccaaagctgtggtggatggaggtgctatcccagcatttatttctctcttggcgtcgccccatgctcacatcagcgagcaagctgtgtgggctcttggaaacattgcaggtgatggctcagttttccgagacttggttatcaaacatggtgcaattgacccactgttggcacttctcgcagttcctgatctgtcatccttggcatgtggttacttgcggaatcttacctggacactttcaaacctctgtcggaacaagaatcccgcaccccccttagatgctgttgagcagatccttcctactctagttcgactcctacaccacaacgatccagaagtattagcagactcctgctgggccatttcctatctgactgatgggccgattgagcgcatcgagatggttgtgaagaagggagttgttccccaacttgtgaagcttttaggagctactgaactgcccattgtgacgccggcactgagagccatagggaatattgtcaccggaacagatgaacagactcagaaagtgatcgatgcaggggcacttgcagtctttcccagcctgctgacaaaccccaaaactaatattcagaaggaggccacatggacaatgtcgaacattaccgccgggcgccaggaccagatacagcaagtggtgaatcacggcctcgtcccatttctcgttggtgtcctctctaaggcagactttaagacacagaaggaagccgcatgggctataaccaactacaccagcggcgggactgttgaacagattgtgtatctggttcattgtggaataatagaacccttgatgaacctcttgagtgcaaaagataccaaaattattcaggttattcttgatgctatttcaaatatctttcaggctgcagagaaactaggtgagacagaaaaactcagtataatgattgaagagtgtggaggcttggataaaattgaagccctacagagccatgagaacgagtctgtgtacaaggcctcgttgaacctaattgagaagtacttctcagtggaggaagaggaagatcaaaatgtggtgccagaaactacctctgaaggcttcgccttccaagttcaggatggagctcccgggacctttaacttctaatgtccagccaaagcacaaagttgttagctatgtgctgtgctgtgctgtgttctcataaatttgtcttactgtttctctactaagaactctttttaaatgtggtttgttattgtagcactttttacaaaagaaactatacttgaacagttataaactgtacatactctatgaagctgtcctctgagtttatttctatgtggaatttcgtaccctgtcgggtcctgtaaataaagatttaagttccattcttcttttaaaaaaaaaaaaaaaaaaaaaaactcgag

SEQ ID NO: 2386 - DNA, 291 bp, Rattus norvegicus
  Genbank Accession No. NM_053485
cagtggtcagtcatggcatgccccctggatcaggccatcggccttctcgtggctatcttccacaagtactctggcaaggagggtgacaagcacaccctgagcaagaaggagctgaaggagctgatccagaaggagctcaccattggtgctaagctgcaggatgctgaaattgcaaggctgatggatgatctggaccgtaacaaggatcaggaagtaaacttccaggagtatgttgccttcctgggggccttggctttgatctacaatgaagctctgaaataaaatgggaag

SEQ ID NO: 2387 - DNA, 2849 bp, Rattus norvegicus
  Genbank Accession No. NM_053492
ccgccatgggctgctgcagctccgcctccgccgcgcagagctccaaacgagaatggaagccgttggaggaccgtagctgcacagacataccatggctgctgctcttcgttctgttctgcattgggatgggatttatttgtggcttttcagtagcaacaggtgcagcagcaagactagtgtcaggatacgacagctatggaaatatctgtgggcagagaaatgcaaaactggaagcaatagcgaacagtggcctggaccacacccaccggaagtatgtgttctttttggacccatgcaatctggacttgataaacaggaagatcaagtctatggcactgtgtgtagcggcatgtccacgacaggagttgaaaaccctgagtgacgtccagaagtttgccgagatcaatggttcagcactgtgtagctacaacataaagccttccgagtacactctgactgcaaaatcctctgccttttgccccaaactaccagtaccagccagtgcacctattccattcttccatcgctgtgctcctgtgaacatttcctgctatgccaagtttgcagaggccctgatcacctttgtcagtgacaatagtgtcttacacaggctgattagtggagtaatgaccagcaaagaaattatattgggactttgcttgttatcactagtyctgtccatgattttgatggtgattatccggtatatctcaagagtgctagtgtggatcctaacgattctggtcatcctgggttcactaggtggcaccggtgtactatggtggctatatgcaaagcagagaagctcccccaaagaaacagttattcctgaacagcttcagatcgcggaagacaatctgcgggcgctcctcatctatgccatttctgctacggtgttcactgtcattctcttcctgatcatgctggttatgcgtaaacgcgtcgctctcaccatcgccttgttccacgtggctggcaaggtcttcatacacctgcctctgctagtcttccagcccttctggactttttttgctctcgtcttattttgggcatactggataatgacacttctcttccttggcactactggcagtgctgttcagaatgaacaaggtttcgtggagtacaaaatctctgggcctttgcagtacatgtggtggtaccacgtggtcggcctgatttggatcagtgagttcattctcgcctgtcagcagatgactgtggcaggagctgtggtaacatactactttacaagggataaacggaatttgcctttcacacctattctggcatcagtgaaccgccttattcgttaccacctcggtactgtggccaaaggatccttcattatcaccctcgtcaagatccccaggatgatccttatgtatatccacagtcagctcaaagggaaggaaaacgcttgtgcacgatgcatgctgaaatcctgcatttgctgcctttggtgtcttgaaaagtgcctgagctacttaaaccagaatgcatacacagccacagccatcaatagcaccaacttctgcacctcagcaaaggatgccttcgtcattctagtggagaatgctctgcgagtggctgccatcaacacagtgggggacttcatgttattcctaggcaaggtgctgatagtctgcagcacgggcctggctgggattatgctgctcaactaccagcaagattacacagtgtgggtgctgcctctcatcatcgtctgcctctttgctttcctagtcgctcattgcttcctgtccatttacgaaatggtagtggatgtgttgtttttgtgttttgccattgatacaaaatacaatgatgggagcccaggccgagaattctatatggacaaagtcctaatggagtttgtggaaaacagtaggaaagcaatgaaagaagctggtaagggaggcgccgcggatgcccgagagctaaagccgatgctcaggaaaaggtgacctgtctctggggactggaagaatggactcaaaggaggctgtttacacaaggctctcccactcaccagctgttgagtttgtgaggaagacaggatcttattacttcaatggccgcgatcaagaaggttctccaaccatatacagccaaatggatttactaccatggggctggctaattaatgattaattcaggggcawtttgatagtaatctgccttggcagccacatcytcaaacttcatgttgctttctcttctggccttgtcatgttgaggtcaagccctgctagtgggtgctggcttgaagtcagaactcacggggtgggggggaattctctgcgctcatctgtcctctcggaactctgctaattatagawtccacgtkgattgytaaytattamtwaggggcctgctgcatgctaagcactgggatgggtgcctgacataatactgaatcctcmcacggccctgtaaagttgctttgtatcgctgacattttgaccatgatgaaatgagatgctcmsararawymtgtkttgtggktaaraycacmcagttgatargatcsgtattcccatttcagaggccctccactataacactatgctttgctcattcytgctacaaagataactgccctgtagcatcccctgtgggtatcactccctgtctcaaattggggtgggtatggcggtgtatgtgcatgggaagtgtcttggggggagggttgtagaagcacagaggaatcacagaattattttctaagcgagataacactgtttgtttatggcccatggatcatatctccctgtccccacctatttttgtaaataaagttttatgggaacacaaccacatcctttataaaaaaaaaaaaaaaaaaa

SEQ ID NO: 2388 - DNA, 1876 bp, Rattus norvegicus
  Genbank Accession No. NM_053516
cggtaattatcgcaattcctacaggcgtaaaagtattcagctgactcgctacactacatggaggaaatatcaaatgatcccccgccatattatgagccttagggtttatcttcttattcacagtagggggcctaacagggatcgtactatctaactcatcccttgacattgtacttcatgatacatactatgtagtagctcacttccactatgtcttatctataggagcagtattcgccatcatagctggcttcgtccactgattcccactattctcaggctataccctaaatgacacatgagcaaaagcccactttgccattatatttgtaggtgtaaacataacatttttccctcaacacttcctagtattagcggggatacctcgtcgttactctgattatccagatgcttacaccacatgaaatacagtctcctctataggctcattcatctcacttacggccgtccttgtaatgatcttcatgatttgagaagccttcgcatcaaaacgagaagtactctcaatttcctactcctcaactaacctagaatgactgcatggatgccccccaccctaccacacattcgaagaaccttcctacgtaaaagttaaataagaaaggaaggattcgaaccccctacaactggtttcaagccaatttcataaccattatgtctttctcaataaaaaaaaaaaaaaaaccacttccttccttcccaggctaccgggaccgcagctatgaccctccatgcccaggccactggacgccagaggcacccagttcagggaccacatgtcctgggctgcccagagcttcagaggaagaggagatcggaggtcctgaggactctgaggcagtacagcctcgaacaccagaggagccagaactagaagctgaagctactaaaggggatgagccagacctggaacaagaaatggaaccagaaccagagccagaggtagaaccggagccagagccggagccggagccggagccggagccggagccggagccggagccggagccggagccagagcgagagcctgacttccaagaaggggatgagtctgaaggttgtgagaacacctaaaccctagcttgcaggcttgttagaaattgtggactgggaagtaggggttgatccccactccactgaccatcattttcatctctagattcttgaaggccagaatatccttacctgtccaaatctgattcaagctggataagatctggaaacctgccagaactggaccaagtcaatgcagcaagactccatttactgccaaatgagtaaactcgggagggttagcctggacctgattcttcacaactcaggctctttactcaagaatggtctgaatcccactgacctgagcaggcttgtgtgaaaaataccatcccccccaccaacagtattccactcccaaagtagcccaagctgtatttctagagatcttagattcaggcccctaaatcagaccctcttccactccctttttccccctcaggggccatttgggagcccaagtgggcaacacttctacaccatggaaacgactagacttaagagtatcaagcaagtgaaggtggctggctgtccatccacacacagagagaagtcttggagctcacagtcttgaaggggggacctgagagaaaactggagtagacagaagccacacgcatcattgtaactgctctttaattgtctggccttcctctgaactgggagctccgtgtggggtgtggggtctaaccagtcacagacatacacaaggagctctgtacattatctactaagcaaatgaataaaaacttcccagctgtgtttccaagctttcacagatggaaaaattaaataaaaagcc

SEQ ID NO: 2389 - DNA, 1857 bp, Rattus norvegicus
  Genbank Accession No. NM_053523
aagacaccaagtgtcgttgtggggtcgcagacggctgcgtcgccgcccgttcggcatccctgagcgcagtcgagcctccagcgccgcagacatggagcccgagccacagcccgagccggtcacgctgctggtgaagagccccaatcagcgccaccgcgacttggagctgagtggcgaccgcggttggagtgtgagtcgcctcaaggcccacctgagccgagtctaccccgaacgcccgcgcccagaggaccagaggttaatttattctgggaagctgctgttggatcaccaatgtctccaagacttgcttccaaagcaggaaaagcgacatgttttgcacctcgtgtgcaatgtgaggagtccctcaaaaaagccagaagccagcacaaagggtgctgagtccacagagcagccggacaacactagtcaggcacagtatcctggggattcctcaagcgatggcttacgggaaagggaagtccttcggaaccttcctccctctggatgggagaacgtctctaggcctgaagccgtccagcagactttccaaggcctcgggcccggcttctctggctacaccacctacgggtggctgcagctctcctggttccagcagatctatgcaagacagtactacatgcaatacttggctgccactgctgcttcaggagcttttggccctacaccaagtgcacaagaaatacctgtggtctctacaccggctcccgcccctatacacaaccagtttccggcagaaaaccagccggccaatcagaatgcagccgctcaagcggttgttaatcccggagccaatcagaacttgcggatgaatgcacaaggcggccctctggtggaagaagatgatgagataaaccgagactggttggattggacctactcagcagcgacattttccgttttcctcagcattctttacttctactcctccctgagcagattcctcatggtcatgggcgccaccgtagtcatgtacctgcaccacgtcgggtggtttccattcagacagaggccagttcagaacttcccagatgacggtccccctcaggaagctgccaaccaggaccccaacaataacctccagggaggtttggaccctgaaatggaagaccccaaccgcctccccgtaggccgtgaagtgctggaccctgagcataccagcccctcgttcatgagcacagcatggctagtcttcaagactttctttgcctctcttcttccggaaggcccaccagccctagcaaactgatggcccctgtgctctgttgctggaggctttcacagcttggactggatcgtcccctggcgtggactcgagagagtcattgaaaacccacaggatgacgatgtgcttctgtgccaagcaaaagcacaaactaagacatgaagccgtggtacaaactgaacagggcccctcatgtcgttattctgaagagctttaatgtatactgtatgtagtctcataggcactgtaaacagaaggcccagggtcgcatgttctgcctgagcacctccccagacgtgtgtgcatgtgtgccgtacatggaagtcatagacgtgtgtgcatgtgtgctctacatggaagtcatagatgcagaaacggttctgctggttcgatttgattcctgttggaatgttgcaattacactaagtgtactactttatataatcagtgacttgctagacatgttagcaggacttttctaggagagacttattgtatcattgctttttaaaacgcagtgcttacttactgagggcggcgacttggcacaggtaaagcctttgccgggttttctgttcaataaagttttgctatgaacgacaaaaaaaaaaaaa

SEQ ID NO: 2390 - DNA, 2458 bp, Rattus norvegicus
  Genbank Accession No. NM_053536
atacggagccgggccgcacgcgcgaggccgtgccaggcgacgccgagtccaggcagtcctgttctgggtcctgggacaccgtgtgcactgaatttgcgtgactgtacagacgctaagtgctcagtatgtggaagttgttgagtattcgtataccctacgtataggagccacgtcacactggcagcaaacagatgtgcgcacagagacgttgtgctgctttcctgaggttgcacagctgacagctgcagacaagtcaccacaggctcggccaggccagcatggtggaccacttgcttccagtggacgagaccttctcgtcaccgaaatgcccagtgggatacctgggagataggctggccagccggcagccataccacatgttgccctcgcccatctccgaggatgacagcgatgtctccagcccctgctcttgtgccagccctgactcgcaagccttctgttcctgctacagtgcaggtccgggccctgaggcccagggcagcatcttggatttcctcctatcccgggccacactgggcagtggtggtgccagtggaggtgtcggagatggcagtggccctgtgacctggggatcgtggaggagagcctctgtgcctgtgaaggaggaacatctttgcttccctgaatttctgtcaggggaccctgatgatgtctccaggcccttccagcctaccctggaggagattgaagaattcttggaagagaacatggaggctgaggtcaaggaggccccagagagcagcagcagggacctggaagcctgtagccagctctcagctgggtcacaccggagccacctccatccagagtccggtgggagagagtgccgtatcccaccaccaggtggcaccagtgggggtggtacccaaggtgcaggtgaggggtcagctcatgatggccccatgccggtgctactgcagatccagcctgttgctgtgaagcaggaagcaggtgcagggccagcctccccagggcaggccccggagagcgtcaaggtcgcccagcttctggtcaacatccaggggcagacctttgcactcctgcctcaagtggtaccatcctccaacttgaacctgtcctcaaagtttgtgcgaattgcgcctgtgcccattgccgccaaacctattggctcaggatccctagggcccggccctgctggtctccttgtgggccagaagttccccaagaacccagcagcagaacttctcaaaatgcacaaatgcactttcccaggctgcagcaagatgtacaccaagagcagccacctcaaggcccacctgcgccggcacacaggcgagaagccctttgcctgcacctggccgggctgcggctggaggttttcacgctcagatgagttgtcacggcaccgacgatctcactcgggtgtgaagccgtaccagtgtcccgtatgcgagaagaaattcgcgcggagtgaccacctctccaaacacatcaaggtgcatcgcttcccacgaagcagccgcgcagtacgcgccatcaactgagcgcagtggccgccctcccctcccccacctccacattttgtttttaaatgcaataacttattgcctctttcagaaggatgtgacaatattaccagtcccccttctgaatcttaggaggtatgacccagagccgccgtggctgcctttccggggaggacccagagtccccaaggtccctgggggctggttccccggtggcccaggtggcccaggcaggcctgtgcccttgtgcctttgtgccttcctgccagctggaagcagtgtttggggggcccttgccctcctcccattgggctccctaccagggccaaagccaacattatcactggggaaggagtgttttggctgtgtcgaaatagtagctcccagaggaagccatgctgagaaaaaggaagtaggtcaaaagcgcagggctgtactgtggtgcgaggaccgccatatgcaagaggcctctgagggtccaggaggatggccaccctcgctctaggccctaacgcaagtgcttaaatgcaagacaaatggagccatatccatccatacccagcctggctcaccctcctccagacgccaacctcctggctgtggtgggaagcgaaaggagcaggtctggtggatgcaaagcgactagctagcgcctcccagtctgacttagatccgcattcctcgtcaggtctagaaattagtaccaattgaactagcttgtttcgacaggtctgtttcacatcctatgaatgtatgtaaataaactgtacataggtgcgcatctacataaaatatcttttaataacacgttgacatttgtgtaaatttgaaatttaaaaaaattctatgaagtcagtgtacatatgttacaattatgtatattttctttggtccttcataaaaaatatatttactttgccaataaaaagagagaaaaaaaaaaagaactc

SEQ ID NO: 2391 - DNA, 1910 bp, Rattus norvegicus
  Genbank Accession No. NM_053537
gtccaagggtccatgtggtaagcagactgaaccgtcctagataccaaagagggacaccttgtgggtgggtagcatgggcttcgaagacctgctggacaaggtgggcggctttgggcccttccaacttcggaatctggttctgatggccctgccccgaatgctgctccccatgcactttctcctgcccgtcttcatggccgctgtgcctgcccaccattgtgccctgcccggtgcccctgccaacctcagtcaccaggacttatggctggaagcccatctaccccgggagactgacggcagctttagctcctgcctccgatttgcctatccccagactgtccccaatgtcactttggggacagaggtgtccaactctggggagcctgagggtgagcccctcacggtgccctgctctcagggctgggagtacgaccgctcagaattctcctccaccattgcaactgagtgggatcttgtgtgtcagcagagaggactgaacaaaattacgtccacctgcttcttcattggtgtgctggtgggagccgtggtgtatggatacttgtctgacaggtttggcaggcgccggcttctgctggtggcctacgtgagctccctggtgctgggtctgatgtctgcagcctccatcaactacatcatgttcgtagtcacccgtacactcaccggctcagccctggctggcttcaccatcattgtgctcccactggagttggagtggctggatgtggagcaccgcactgtggccggggtcatcagcaccgtcttctggtcgggaggcgtgctgctgctggcactggtgggctacctgatccggagctggcgctggcttctgctggctgccaccctgccgtgtgtcccaggcatcatcagcatctggtgggttcctgagtctgcacggtggcttctaacccagggtcgtgtggaggaggcaaaaaaatacttgctgagctgtgccaagctcaatgggcggcccgtgggtgagggcagcctgagccaggaggccctgaacaacgtggtcaccatggaaagggcgttgcaaagaccctcatacttagacctgttccgaacatctcagctccgacatatctcactgtgctgcatgatggtgtggtttggagtgaacttttcctactacggcctgactctggacgtgtctgggctggggctgaacgtgtaccagacacagctgctgtttggggctgtggagctcccctccaaaattatggtctacttccttgtgcgccgtctgggacgccgtctcacggaggctgggatgctgctgggcgctgctctgacctttggcaccagcctgctggtatccttggagactaagtcatggatcactgctctggtggtggtggggaaagctttttctgaagctgcttttactacggcctacctgttcacgtccgagttgtaccctactgtgctcagacagacaggattgggacttactgcactcatgggcaggctaggggcctctctggcccgactggcggccttgctggatggagtgtggctgttgctgcccaaagttgcttacggggggattgccctggtggctgcctgcactgcactcctgctgcctgagacgaagaaggcacagctgccagagaccatccaggatgtggagaggaagagtacccaggaggaagatgtgtaggtccgggactgagttggactagcgacagttctccacaggagctgggcacagaaggcagcctcttgtgactgggacatcagactcctccacctaaggatggagctgctcctgatgccctctgcctgtgctctccagcagcagaacaacttcccgcagcactgggccgctgggattctggactcccctctcatggccgggggcttctataaataaagacggttgctcatgg

SEQ ID NO: 2392 - DNA, 1435 bp, Rattus norvegicus
  Genbank Accession No. NM_053551
gaattccggcacagcgcacttgctctcgctcgaccgcgctcccgccccgcagtcctcaccaaccctacggatcctagccaccgccagcctaggagggcatcaggatgaaggcagcccgtttcgtgatgcgcagcgccagctcgctgggcaacgccggcctggtccccagggaggtcgagctgttctcccgctacagcccgtccccgctgtccatgaagcagctgctggacttcggttcagaaaatgcctgtgagagaacttctttttcttttcttcggcaagaattgcccgtcagacttgccaacatcctgaaggagattgacatcctccctgaacacttagtgaacaccccttccgtccagctggtgaagagctggtacatccagagcctgatggatttagtggagttccacgaaaagagcccagaagaccagaaagttctatcagactttgtagacacgctggtcaaagttcgaaacagacatcataatgtggtccctacgatggcacaagggatcctggagtacaaagacaactgcaccgttgaccccgttaccaatcaaaatcttcagtattttttggaccggttttatatgaaccgcatttctactcggatgctcatgaaccagcacatcctcatattcagtgactcaaagacaggaaacccaagccacattgggagtatcgaccccaactgcgatgtggtagcagtagtcgaagatgcctttgagtgtgcaaagatgctctgcgatcagtattatctaacgtcgccagaattaaagctcacacaagtcaatggaaaatttccaggccaaccaatccacatcgtgtacgttccttcacaccttcaccacatgctctttgaactattcaagaatgccatgagggccacggtcgagcatcaagaaaaccgccctttcctgacaccagtcgaggccaccgtcgtcttgggaaaagaagatcttacaatcaagatttctgaccgaggtggcggtgttcctctgaggattactgaccgcctctttagttacacatactccactgctccaacgcctgtgatggacaattcacggaatgcccctttggctggttttggttacggcttgccgatttcccgtctctacgccaagtattttcaaggagatctgaatctctattccatgtcaggctatgggacagatgccatcatctacttaaaggctttatcatctgagtctatagaaaaactccccgtctttaacaagtcagccttcaaacattatcagatgagttctgaggctgatgactggtgtatcccaagtaaggaaccaaagaatctgtcgaaggagaaactggcagtgtgacggggatctcgcctggcacttttacgggatcaaagtgggtctacggcagtgctgcttcgtgaatgtgtgtggactcttgtttccgcaaaaca

SEQ ID NO: 2393 - DNA, 1108 bp, Rattus norvegicus
  Genbank Accession No. NM_053553
ttgcttttaataacactgaaccccatcagagccagaagcaggtgcccgctgcagtttttgacacatgccactttccctacagctggaggccttgggttccatttacagtactggggtggggggataaggcctagtaaaaccctctcctcaaagatgcccttgagggtcggcggcgacggcgacatggagagcggggcctatggcgcggccaacgcgggcggctccttcgacctgcggcgctatgtgtcccagcctcaggtggtgacacgcctcgtgagcatggtcttggccttgatcgtattctcctgcatcttcggcgagggctacatcaaccttcactcatctgaccagctacactgtgtgttcaaccggaacgaagatgcctgccgctacggcagtgccattggggtgctggccttcctggcctcagccttcttccttgtggtggatgcgtttttctctcagataagcaatgccactgaccgcaagtatctggtcattggtgacctgctcttctcagctctctggaccttcctgtggtttgtcggtttctgctttctgaccaaccagtgggcagccaccaaacctgatgacgtgttggtgggagcagactcagcccgggctgccatcaccttcagtttcttctccatcttctcctggggtgtgctggcctccctggcctaccagcgttacaaggctggagtggatgccttcattcagaactatgtggaccccacgccggatcccaccacagcctacgcctcctaccctagtgcctcggtggaaaactaccagcagccgcccttcacccagaatgtggagactactgagggctaccagcctcccccagtgtactgagcagccagggacaaagaggcaggagggtgcttggtggggctgcccctccaccctggacttctctcaaggtttgctgtccagaactgtagtcccttggctgttacagttgacagcccgagtccatgcctttctgcaccccagcagccagagcacacctgaagtgcccatgcccagaggggcttcaccgccacccgcctgaccctcaagggcatctttgaggagagggttttactaggccttatccccccac

SEQ ID NO: 2394 - DNA, 309 bp, Rattus norvegicus
  Genbank Accession No. NM_053555
atggcagggaaagaattggagcgatgccagcggcaggcagaccaagtgacggaaatcatgctcaacaatttcgacaaggtcctggaacgcgatgggaagctgtcagagttgcagcagcgctcagaccagctcctggacatgagttctgccttcagcaagacaaccaagactttagcccagcagaagcgctgggagaatatccggtgccgggtctacctggggctagccgtggctggcggccttctcctcatcctggttgtgcttctggtcatctttcttccgagtggagaggacagtagtaaaccatag

SEQ ID NO: 2395 - DNA, 1511 bp, Rattus norvegicus
  Genbank Accession No. NM_053563
tgggctcaaggaaggaagcgttgtagctcgcgtccaggggcgcggcgtgtacgggtggctctcttcgcagctcgcggaggcgaaccgggcaacagtgacatggcagaacaggatgtggaaaatgagcttttggattatgatgaagatgaagagccccaggtaccccaggagagcactccagctcccccgaagaaagatgtcaaaggatcttatgtctccatccacagttctggcttccgggactttctgctgaagccggagctcctgagagctatagttgactgtggctttgaacatccttcagaggtccagcatgaatgtattccccaggccattctgggtatggatgtcctgtgccaagccaagtctgggatgggcaagacagctgtgtttgtgctggccaccctgcagcagattgaacccatcaatggccaggtatcagtactggtcatgtgccacacaagggagctggccttccagatcagcacggagtatgagcgcttctcgaagtacatgcccagtgtcaaggtatctgtgttctttggaggcctctccattaagaaagatgaagatgtgttaaagaagaactgtccccatgttgtggtggggacaccaggccggatcctggccctcgtgcggagcaggagcctcaacctgaggaatgtgaagcactttgtgctagatgaatgtgacaagatgctggaacagctggacatgcgccgggatgtacaggagatctttcgtctgacaccccatgagaagcaatgtatgatgttcagcgccaccctgagcaaggagatccggccagtctgcaggaagttcatgcaggatcctatggaggtgtttgtggacgacgagaccaagctcacactgcatgggctgcagcagtattacgtcaaactcaaggacagtgagaagaatcgtaaactcttcgacctccttgacgtgctagagtttaaccaggtggtgatctttgtcaagtctgtgcagcgctgcatggccctggcccagctcctagtggaacagaattttccggctatcgctattcacagaggcatggcccaggaggagcgcctgtcccgataccagcagttcaaggacttccagcgtcgcatcctagtggctactaatctgtttggcagaggcatggacattgagagagtcaacatcgtcttcaactatgacatgccagaggactcggatacctacctgcaccgagtggctcgtgctggtcgctttggtaccaagggtctggcagtcacttttgtgtcagatgagaatgatgccaaaatccttaatgacgttcaggaccggtttgaagtgaatgtggctgagcttccagaagaaatagatatctccacatacattgagcagagccggtaaccatgtgtgtagccaggcacatggctttctctcctgctgcttcagatcctcctcctaggtggcaatcggcggcctctctttttattgttccaaagctttagctatgttaagaataaacttttattgtg

SEQ ID NO: 2396 - DNA, 863 bp, Rattus norvegicus
  Genbank Accession No. NM_053565
cgctggctccgtgcgccatggtcacccacagcaagtttcccgccgccgggatgagccgccccctggacaccagcctgcgcctcaagaccttcagctccaagagcgagtaccagctggtggtgaacgccgtgcgcaagctgcaggagagcggattctactggagtgccgtaaccggcggcgaggcgaacctgctgctcagcgccgagcccgcgggcacctttcttatccgcgacagctcggaccagcgccacttcttcacactgagcgtcgagacccagtcggggaccaagaacctacgcatccagtgcgaggggggcagcttttcgctgcagagtgacccccggagcacgcagccagtgccccgctttgactgtgtactcaagttggtgcaccactacatgccgcccccaggggccccttccttttctttaccaccgacggaaccttcctttgaggttcaggagcagccacctgcccaggcactccccgggggtacccccaagagagcttactacatctattctgggggcgagaagatcccgctggtactgagccgacctctctcctccaacgtggctaccctccagcatctttgtcggaagactgtcaacggtcacctggactcctatgagaaagtgacccagctgcctggacccattcgggagttcctggaccagtatgatgctccactttaaagagcaaagaaagggtcagagggggcctggatcggtcgcctctcctccgaggcacatggcacaagcacaaaaatccagccccaatggtcggtagctcccagttagcccagcagaagataggcttcttcctcaggccctccactccgcagagtagagctggcaggacct

SEQ ID NO: 2397 - DNA, 1846 bp, Rattus norvegicus
  Genbank Accession No. NM_053568
tgtgtcgcgggagctgccaggacttgcggggggcctctggtgccatgatccggaacgggcacggggctggcggcgctgctgggctgaagggtccgggcggccagcgcaccgtgcgggtgtggtgcgatggctgctatgacatggtgcattacggccactccaaccagctacgccaggcgcgggccatgggggactacctcattgtgggcgtgcatactgacgaggagattgccaagcataaggggcccccggtgtttacccaggaggagcggtacaagatggtacaggccatcaagtgggtggatgaagtggtaccggctgctccctacgtcaccacactggagacactggacaagcacaactgtgacttctgcgttcatggcaatgacatcacgctgacagtagatggccgagatacctacgaggaagtgaagcaggctgggaggtacagagagtgcaaacgcacccagggtgtgtccaccacagacctcgtgggtcgcatgctgctggtgaccaaggcccaccatagcagccaggagatgtcctctgagtaccgggaatatgctgacagttttggcaagccccctcacccgacacctgccggggacacactttcctcagaagtctcctcccagtgccctggggggcagagcccctggacaggggtgtcccagttcctacagacatcccagaagatcatccagtttgcttctgggaaggagccccagcccggggagacagtcatctatgtggctggtgcctttgacctgttccacatcgggcacgtggacttcctacaggaggtgcacaagctagccaagaggccctacgtcatcgcgggcctacactttgaccaggaagtaaaccggtacaagggcaagaactaccccatcatgaacctgcatgagcggactctcagtgtgctggcctgccggtatgtttcagaagtggtgattggggcaccgtactccgtcacagcagagctcctgaatcatttcaaggtggacctggtgtgtcatgggaagacagaaattgtacccgacagggatgggtctgacccctacgaggagcccaagagaagaggcattttctgtcagattgacagtggcagtgacctcactacagacctgattgtgcaaaggatcatcaagaacaggttggagtacgaagcacggaatcagaagaaggaagccaaggaattagcctttttggaggccctgaggcagcaggaggcacagcccagaggggagactgactagcttctgacccggagacgtcattcacgccgttgccctgtgcccacctcatctctccctgccctgctctgcttctgtgtcttggtgtcagctcacacaattccaaaggaaactggccttgctgagggtgctgtccctgcctgcctgcagcaggctctcagtcctttccactgagctgctcagagagggtagctagcccagtggggcagccccgtggacaggataagcagacggcacctgtgactggaggattgttgctgtgtatccttggcatccacgggttccaactgcccactgtcccagtttggctggggatacccctcctgcctgactggaagctgcacttctgcccaccgagctttggtgaaaggtacagaggctttggggacctctgttcctgggccaccctgcacgtgggcaccctctaccttggggcacgttctagcaccccattcctgactcctagaagatgcacttgccccgggtggctgggccagcgtggctgccctccgcacagacttcctggtcctcgtttgtacctcagtggctgatgtaaacctctttggctcaactgaataaagcctagtggg

SEQ ID NO: 2398 - DNA, 1414 bp, Rattus norvegicus
  Genbank Accession No. NM_053576
gcgcctccttgttcccagcgtcaccactgccgccatgcccggagggctgcttctcggggacgaagcccccaactttgaggccaataccaccatcggccacatccgcttccacgatttcctaggagattcatggggcattctcttttcccacccacgggactttaccccagtgtgcaccacagaacttggcagagctgcaaagctggcgccagagtttgccaagaggaatgttaagttgattgctctttcaatagactctgttgaggaccattttgcctggagcaaggacatcaatgcttacaatggtgcagcacccacagaaaagctaccatttcccatcatcgacgataaggacagggaccttgccatcctgttgggcatgttggatccagcagagaaggatgaaaaaggcatgcccgtgacagcccgtgtggtattcatttttggccctgacaagaaactaaaactgtccatcctctacccagccaccacgggcagaaactttgatgagattctcagagtggttgactccctccagctgacagcatcaaatccagttgccactccagttgactggaagaagggagagagtgtgatggtccttcccaccctccctgaagaggaagccaaacaacttttccctaaaggagtcttcaccaaagagctcccatctggcaagaaatacctccgttatacgccccagccttaagtctgcgggaactggggctgcaactgctcgaccagcactgggacctgaggatgacagctgacagctgcagttccgtagaaagattgtggcgtggtcacagccgaagtcgcgtaggtcgctcgctatactactggctcattaaatggaaatggcaccaaaacattctcgggattctttactctgtgccttcgccagcattctgcccctccatccatcacagcgccctgctgactggctttctttgaaacgaattatgtgttggtgactgcagggtctctgcagggtctgtgatcagcaaggtagtgtcagtgtgggctccatgctagaatgataaacatcttttgtaggtttccaaactgaatcttctgttacccattgtggagaaccataaagtggggagaaactttcaattctgtactttcagtaaataaagcaggggaggtggggggggggggagagttctctataggaaatccatggtgagtttctatcaaagtgggcttccaagaatgtgtggaagacagcacatgtacttcctggagtttccaggtctgctctctagtgatctgtgaatgtgaactcgccttatgaaagacaggcagtgacattgtttgccactaaatgtcctaaaggagtgggttgccatttctaaattctgctgtgtgaggttcaacaataaaatcctgattagaaaaaaaaaaaaaa

SEQ ID NO: 2399 - DNA, 3098 bp, Rattus norvegicus
  Genbank Accession No. NM_053580
aagttcccactccagacttctgcgagaacccgtgaggaagcagcgagaaccgggggtttgcaagccagagaaggatgcggactccgggagcaggaacagcctctgtggcctcattggggctgctttggcttctgggacttccgtggacctggagcgcggcggcggcgttcggtgtgtacgtgggtagcggtggctggcgatttctgcgtatcgtctgcaagacggcgaggcgagacctctttggcctctctgttctgatccgcgtgcggctagagctacgacgacaccggcgagcaggagacacgatcccacgcatcttccaggccgtggcccagcgacagccggagcgcctggcgctggtagatgcgagtagcggtatctgctggaccttcgcacagctagacacctactccaatgctgtggccaatctgttcctccagctgggctttgcgccaggcgatgtggtggctgtgttcctggaaggccggcccgagttcgtgggactgtggctgggcctggccaaggccggtgtagtggctgcgcttctcaatgtcaacctgaggcgggagccccttgccttctgcttgggcacatcagctgccaaggccctcatttatggcggggagatggcagcggcggtggcggaggtgagtgagcagctggggaagagcctgctcaagttctgctctggagatctggggcctgagagcgtcctgcctgacacgcagcttctggaccccatgcttgctgaggcgcccaccacacccctggcacaggccccaggcaagggcatggatgatcggctattttacatctatacttctgggaccaccggacttcctaaggcggccattgtggtgcacagcaggtactaccgcatcgcagccttcggccaccattcctacagcatgcgggccaacgatgtgctctatgactgcctacctctctaccactcagcagggaacatcatgggcgtgggacagtgtatcatctacgggttaacggtggtactgcgcaagaagttctccgccagccgcttctgggacgactgtgtcaaatataattgcacggtagtgcagtacatcggtgaaatatgccgctacctgctaaggcagccggttcgcgatgtagagcggcggcaccgcgtgcgcctggccgtgggtaacggactgcggccagccatctgggaggagttcacgcagggtttcggtgtgcgacagattggcgagttctacggcgccaccgaatgcaactgcagcattgccaacatggacggcaaggtcggctcctgcggcttcaacagccgtatcctcacgcatgtgtaccccatccgtctggtcaaggtcaacgaggacacgatggagccactgagggactcccaaggcctctgcatcccgtgccagcccggggaacctgggcttctcgtgggccagatcaaccagcaagaccctctgcggcgcttcgatggctatgttagtgacagcgccaccaacaagaagattgcccacagcgtgttccgaaagggggacagcgcctacctttcaggtgacgtgctagtgatggacgagctggggtacatgtacttccgtgaccgcagcggggataccttccgatggcgcggcgagaacgtatccaccacggaggtggaagccgtgctgagccgcctgttgggccagacggacgtggctgtgtatggagtggctgtgccaggagtggaggggaaaagcggcatggcggccattgcagacccccacaaccagctggaccctaactcaatgtaccaggaattgcagaaggttcttgcatcctatgcccagcccatcttcctgcgtcttctgccccaagtggatacaacaggcaccttcaagatccagaagacccgactacagcgtgaaggctttgacccccgccagacctcagaccggctcttctttctagacctgaaacagggacgctacctacccctggatgagagagtccatgcccgcatctgcgcaggcgacttctcactctgagcctggtgagtgggatggccctggacttgtgagaccagggagccggacacccctgttcaggtgtttctcctgcctggccacgtggccagcagcacctgtgggtgcaggaaactggaacctgagtggccgggtgtccctttcctacaacccaccatgcacacatctagcctctgccttggtctttttctccatctctttcctccgtgcccagcaggagccccacagacacattggctgctgtgtcctgcagtgggaccggtgtctaggggtccatgctgcaggctgtgacccgcactggtgcccacctcccttccccattgtgccttaggttcctccactgtgcgccggtgaagcaagtggggacccacatagctgttgtccctgctgagggttggtagcaaatgcaccctcatgtcagctgggagacacatgcagtctcccactgacccccaatcaactgaagatactgttttgtattattgttttgagatagggtctcactgtggaggccaagctggcctcaggctcaccactctactgcctccgggcaccagcctgcagtttgatgacatgtatgcactattgttctaagggtcttctgagtccctgctttcccctcatgtcctaaaaccttccagaactgactctgatcacttggatgtagctagtgttggccctgcccacgtgtgtcaattcaggggtccccaggcatcatctctggaggccctaaccttggcaaagcttggatgtcctcacatcacagcaggagacccaggaaggttgctgtggtgtctcttgggcacccctggcggcagccgtggacatgcttccctgctgtgatagcccaaactgttgcctatgacatttgaggtctacccttctggctgccatggtccccattgagatctttggtgactcacctcagccaccaagccaggcctctgccttccttcagctctaagggcatgaagggtgtggacagagcagccacaggctgcccacagtcacccacatgcaagtgttatttccttgtttgttttaaaaaaataaacatgctgagccttgaaaaaaaaaaaaaaaaaa

SEQ ID NO: 2400 - DNA, 1869 bp, Rattus norvegicus
  Genbank Accession No. NM_053582
ccaccatgtggggatgtccgctagggctgctattgctgctgctggctggccaggctgccctggaggcccggcggagtcgttggcgcagggagctggcgccagggctgcacctgcggggcatccgggacgccggtggcagatactgccaagagcaggacatgtgctgccgcggccgtgctgacgagtgtgctttgccctacctgggagccacctgttactgtgacctcttctgcaaccgcaccgtctctgactgctgccctgacttttgggacttctgcctcgggattccaccccccttccctcctgtccaaggttgcatgcatgcgggccggatctacccaatcttcggaacctattgggaaaactgcaatcggtgcacctgccatgagaaagggcagtgggaatgtgaccaggagccatgtctagtggacccagccatgattaaagccatcaaccggggcaactacgggtggcaggctgggaaccacagtgccttctggggcatgaccctggatgagggcattcgataccggctgggcacaatccgcccatcttcctctgtcatgaatatgaatgaaatttatacagtgctgggacaaggagaagtgctacccactgcctttgaggcttccgagaagtggcccaacctgatccatgagccgctggaccagggcaactgtgcgggttcctgggctttctccacagcagctgtcgcatctgaccgagtgtccatccattctttgggacacatgacacccatcctctcaccgcagaacctgctatcctgtgatacccaccaccagaagggctgccgaggtgggcgtctcgatggtgcttggtggttcctgcggcgccgaggggtggtgtctgataactgttacccattctccggccgtgagcagaacgacgaggccagccccactcctcgatgcatgatgcacagccgcgccatggggcggggcaagcgccaggccacttctcgctgccccaatagtcaggttgattccaatgacatctaccaggtcacgcctgtctaccgcctggcctccgatgagaaggagatcatgaaggagctaatggaaaatggccccgttcaagcgcttatggaagtacacgaagacttcttcttgtaccagcgaggcatctacagccacacacctgtaagccaggggaggccagagcagtaccgccgacacgggactcactctgtcaagatcacagggtggggagaagagacactgccagacggaaggacgatcaagtactggactgctgccaactcgtggggcccatggtggggtgagaggggccacttccgaatcgtgcgtggcatcaacgagtgtgacatcgagaccttcgtgctgggcgtctggggccgcgtaggaatggaggacatggggcaccactgagtctcggccactaagctaggtgggatccacagccacggaagaggccttgggggccacgccgatgaggccttgggaccaggtgctaatcccctcagactcagatccacacaaacgcagaaccccacctgggagctaatgtccctcagggagcaacagtgaggctggagggaaccctcagacatcacagccggaactggaaagggcccggcttggaaactgcagggagtaaaattcccaggcccctggtcagccagcccaagaccatgggagctaagacaccccaacctctttatcctcctacccaacctcattcttattttttcattctctttggtggattctgcccatccccctggcctccgttctggctggacctttccatcctcaacactgctttcttactctttaaaaatatttatttttcttttcattaaaataaaaccaaagtattgataattgc

SEQ ID NO: 2401 - DNA, 4665 bp, Rattus norvegicus
  Genbank Accession No. NM_053583
attgcttgcttcctaggggccagggctgttctgagcacgtcacaccaatccaagcttcacaaacacctatgggcagttgaagagggggaggcctcggacttctcgctggcctgggattcctctgtggcagcagcgggaggcctagaaggagagtcagagtgtgatcggaaatccagccgtgcgctggaagacaggaacagcgtgacaagtcaagaggagagaaacgaggacgatgaagatgtggaagatgagtcaatttacacctgcgatcactgtcagcaggacttcgagtctctggcagacctgacggaccaccgggcccaccgctgtcctggagatggtgatgacgacccacagctctcctgggtggcttcatctccctccagcaaggatgttgcgtcacccacgcagatgatcggcgatggttgtgaccttggcctcggcgaggaggaaggcggcaccggcctgccgtacccttgccagttctgcgacaagtccttcatccgcctgagctacttgaagaggcatgaacagatccacagcgacaagctgccgttcaagtgcaccttctgcagccgcctcttcaaacacaagaggagccgggaccggcacatcaagctgcacacaggcgacaagaagtaccactgccacgagtgcgaggcggctttctcccgcagggaccacctcaagatccacctgaagacccacagctccagcaagccgttcaagtgcagcgtgtgcaaacgcgggttctcctccaccagctccctgcagagccacatgcaggcccacaagaagaataaggaacacctggctaagtcagagaaggaagccaagaaggacgacttcatgtgtgactactgcgaggacacctttagccagacagaagagctggagaagcatgtgcttaccctccacccgcagctctcagagaaggcggacctccagtgtatccactgccccgaggtctttgtcgacgagagcacgctgctggcccacatccaccaagctcacgccaaccagaaacacaagtgccccatgtgccctgagcagttctcctccgtggagggtgtgtactgccacctggacagccaccggcagcctgattccagcaatcacagtgtcagccccgaccccgtgctgggcagtgtggcttccatgagcagtgctacacctgactcgacgcccgaccccgtgctgggcagtgtggcttccatgagcagtgctacacctgactcgagcgcctctgtggagcgcgggtccacgccagactccaccttgaagccgctgagggggcagaagaagatgcgggatgacgggcagagctggtccaaggttgtctacagctgcccctactgttctaagcgggactttaccagcctggctgtgctagagattcatctgaagaccattcacgcggacaaacctcagcagagtcacacgtgtcagatttgcctggactccatgcccacgctctacaacctcaacgagcatgtgcgcaagctgcacaagagccacgcttaccccgtcatgcaattcggcaacatctccgccttccactgcaactactgccccgagatgttcgcggacatcaacagcctgcaggagcacatccgagtctcgcactgtggccccaatgccaacccccccgacgggaacaatgctttcttctgtaaccagtgttctatgggctttctcactgaatcctccctcacagagcacatccaacaggcacactgcagtgtggggagcaccaagctggagtctcccgttatccagcccacacagtccttcatggaggtctactcctgcccttactgtaccaactcccctatctttggctccatcctgaagctcactaagcacatcaaagagaaccacaagaacatcccgttggcacacagcaagaagtccaaggcggagcagagtccggtctcctctgacgtcgaggtgtcttccccgaaacgacagcgcctctcggggagtgccaactccatctctaacggcgagtacccctgcaatcagtgcgacctcaagttctccaacttcgagagcttccagacccacttgaagctgcacctggagctgctgctccggaagcaggcctgcccccagtgcaaagaggacttcgactctcaggagtccctcctgcagcatctgaccgtgcactacatgaccacgtccacccactacgtctgcgagagctgtgacaagcagttctcctcagtggacgacctgcagaagcacctgctggacatgcacacctttgtgctataccactgcaccctgtgtcaggaggtcttcgactctaaggtgtccatccaggtgcacctggccgtgaagcacagcaacgagaagaagatgtaccgttgcaccgcctgcaactgggacttccgcaaggaggctgacctgcaggtgcacgtcaagcacagtcacctcggcaacccggccaaggcccacaagtgcatcttctgtggtgagaccttcagcaccgaggtggagctccagtgccacatcaccacgcacagcaagaagtacaattgcaggttctgcagcaaagccttccacgccgtcctcctgctggagaagcaccttcgggagaagcattgtgtgtttgacccagctgcagagaatggcacggccaacggggtgccccccacctccaccaagaaggcagagcccgccgacctgcagggcatgctgctcaagaaccctgaggcaccgaacagccacgaggccagtgaggacgatgtggatgcatcagagcccatgtacggctgtgacatctgtggtgcagcctacaccatggaggtgctgctgcagaaccaccgactccgggatcataacatccggcccggagaggacgatggctcacgcaagaaggcagagttcataaagggcagccacaagtgtaacgtgtgctctcggactttcttctcggagaacgggctccgggaacacctgcagacgcaccggggccctgccaagcactacatgtgtcccatctgtggcgagcgcttcccctcgctgctgacgctcactgagcacaaggtgacccacagcaagagtctggacacaggcacctgtcgcatctgcaaaatgcccctgcagagtgaggaggagtttatcgagcactgccagatgcaccccgacttgcggaactccctcactggtttccgctgtgtggtctgtatgcagactgtcacctcaaccctggagctcaagatccatggcacctttcacatgcagaagctggctggcagctcagctgcttcctcccccaatggccaggggctgcagaagctctacaagtgcgccctgtgcctcaaagagttccgtagcaagcaggacctggtcaggcttgacgtcaatgggctgccctatggcctatgtgccggctgcatggcccgtagtgccaatggacaggtgggtggcctggccccacccgaacctgccgaccggccctgcgctggcctccgctgccctgaatgtaacgtgaagtttgagagtgctgaggacctggagagccacatgcaggtggaccaccgtgatcttaccccagagaccagtgggccccggaaaggtgcccagacgtcaccagtgccccggaagaagacgtaccagtgcatcaagtgccagatgaccttcgagaacgagagagagatccagatccacgtcgccaaccacatgatcgaggaaggcatcaaccatgagtgtaagctgtgcaaccagatgttcgactccccagccaagctcctttgtcacctcatcgaacacagcttcgagggcatgggtggtactttcaagtgccccgtgtgcttcacagtcttcgtccaggccaacaagctgcaacagcacatcttcgccgtgcacgggcaggaggacaaaatctacgactgctcgcagtgcccacagaagtttttcttccagacagagttgcagaaccacacgatgagccagcacgcacagtgagggacctcgcgacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtgttttttattgtcctgctacagctagtgtgcttttagagttttcgccgcagactacatttctagtgttagagaaacctgcttttttgaggctattgtcctttgttccttcatgtattatattgatagttttttttaaaggattagtgtgattttttttgcttcttttctatttctttctttcttgtttttctttctcccccttcagttaactactttttaattgaaattctaggtaattgtgcatcgtgatgtgattgcttggctattgtctgaatatttccttttaattttttaattaaagactaatgctttgattggatttgccagttcaccggacagtgattaaaactctgtaatgaaaataatcggtttccgtgcaactggatggtctgcttttaaatgtgacttgatctgactgcagtaactagttcagctcaataaagggaatccatgcgttcacccccaaaaaaaaaaaaaaaaaaaaaaaaaaaaa

SEQ ID NO: 2402 - DNA, 5249 bp, Rattus norvegicus
  Genbank Accession No. NM_053585
gaattctcgcacgaggcgccggctcgccgcggcgctgggctaggaagcgacgggcgcttcgcggttcggagacgtccggcgggcctggcaggttcctcggagagtagattttatcaagattcctccctggaacgctggctccttgctcagtgccctgaagtctctctgcgatgaactgatacattggaaccatggtgcaaaagaagttctgccctcggttacttgactatctagtgatcgtaggggccaggcatccaagcagtgacagtgtggctcagactcctgaacttctgcggaggtacccactagaggaccacccggagtttcccctgcccccagatgtggtgttcttctgccagccagagggatgtctgagcgtgcggcaacggcgcatgagcctccgagatgatacctcttttgtcttcaccctaaccgataaggacactggagtcacccgttatggcatctgtgtcaacttctaccgttcctttcaaaagcgaatgccaaaggaaaaggcggaaggcggagcaggaccccgtgggaaggaaggagctcatgccccctgtgcctcagaagaggccgccaccgagagctcagagagtggctcaaccttgcagcctcctagtgctgactccactcctgacgtaaaccagtctcctcggggcaaacgtagggcaaaagcaggcaaccgctcccgaaacagtaccctgacatccctgtgtgtgcttagccactaccctttcttctctaccttcagagagtgtctgtatactctcaaacgtctggtagactgctgtagtgaacggctcctaggcaagaaaccgggcatccctcgaggtgtacaaagggacaccatgtggcgaatctttactggatcactgctagtggaggagaagtccagtgcccttctgcatgaccttcgagagatcgaggcctggatctatcggttgctacgctccccggtgcctgtctctgggcagaagcgagtggacattgaggtcctaccccaggaagtgcagcaggccctgacatttgctcttccagatccatcccggttcaccctagtagatttccctcttcaccttcccttggaacttctgggtgtagatgcttgtcttcaggtgctaacctgcatcctgttggagcacaaggtggtgctacagtctcgagactacaacgcactctccatgtctgtgatggcgtttgtggcaatgatctaccccctggagtacatgttccctgtcatcccgctgcttcccacctgcatggcttcggcagagcagctactcttggctccaaccccatatatcattggagtccctgccagctttttcctctataagctagacttcaaaatgcctgatgacgtgtggctggtggatctggacagcaacagggtgattgcccccaccaatgcagaagtgctacccatcctgccagaaccggaatcattagagctgaaaaaacacttaaagcaggctctagccagcatgagtctcaacacccagcccattcttaatctggagaaattccatgagggccaggagacaccacttctcttgggaaggttttctaatgaccttcagtctacaccttccactgaattcaacccactcatttatggcaatgatgtagattcagtcgatgttgcaacgagagtggccatggttcgtttcttcaactctgctaacgtgctgcagggctttcagatgcacacacgtaccctgcgactcttcccccggcccgtggttgccttccaagctggctcctttctggcctcacgcccccggcagaccccctttgctgagaaactggccaggactcaagccgtggagtactttggagaatggatcctgaacccttctaactatgccttccagcggattcacaacaatacgtttgatccagccctcattggtgacaagcctaagtggtacgctcaccagctgcagcccattcactatcgagtctatgacagcaattctcagctggctgaggccctgagtgtgccaccggagcgtgattctgagtctgaccccactgatgacagtggcagtgacagcatggactatgatgactcaagctcttcttactcctccctgggggacttcgtcagtgaaatgatgaagtgtgacatcaatggcgacactcccaatgtggatcctctgacgcatgcggccctgggagacgccagtgaagtggagattgatgagctgcagccccagaaggagggagaggagcctggcccagacagtgagaactctcaggagaaccttcccctgcgctccagctccagcaccactgccagcagtagccctagcaccatcgtccacggcgcccactctgaacctgctgattctacagaggtgggagataaggcagcaacaggcatctccaagcccctccctcctgtgcctcccagcatttgcaaatctactgtggacaggagacagacagagactggagaggggtcagtgtgccagcgaacctacgaccatccatattttgagccccaatatggctcccccgctgaggaagatgatgacgagcagggagagagctacacgccccggttcagccaacatgccagtggcagtcgggctcaaaagctgctgcggcccaacagcttgaagctggccagtgactcagacgcagagtcagactcccgagcaagctctcccaactccaccgtctctaacaacagcaccgagggcttcgggggcatcatgtcttttgctagcagcctgtatcggaaccatagtacaagcttcagcctttcaaacctcacactgcccaccaaaggtgcccgagagaagactacaccattccccagcctgaaaggaaacaggagggccttagtggaccagaaatcatctgtcattaaacacagcccaactgtgaaaagagaacctccatcaccgcagggccggtccagcaattctagcgagaaccaacagttcctgaaggaggtggtccacagtgtgctggatggccagggagtcggctggctcaacatgaaaaaggtgcgccggctgctggagagtgagcagctccgagtctttgtactgagcaagctgagtcgtgcagtgcagtcagaggatgatgcccgacaggatgtcatccaggatgtggagatcagtcggaaggtgtacaagggaatgctagacctcctcaagtgcacagtcctcagcctcgagcagtcctatgcccatgctggtctgggtggcatggccagcatctttgggcttttggagattgcccagacccattactatagtaaagaaccagacaaacgcaagagaagtccaacagagaatgtaaataccccagttggcaaggatcctggtctggctgggcggggggacccaaaggcaatggctcagctaagggtccctcagctgggtcctcgggcaccaagtgctacaggaaggggtcctaaagaactggacaccagaagtttaaaggaagagaattttgtagcgtctgtgggaccagaggtcatcaagcctgtctttgacctgggtgagactgaggagaaaaagtcccagatcagcgcagacagtggtgtgagcctggcatctgcttcccagaggactgatcaagactctgtcatcggtgtgagtccagctgttatgatccgaagctcaagtcaggattctgaagtgagtaacagttcaggagagaccctcggagcagacagtgacctgagcagcaatgcaggtgatgggccaggaggcgaaggcagtgcccacttggcaagttctcgggctactctgtctgacagtgaaattgaaaccaattctgctacaagcaccatctttggtaaagcccatagcttgaagccaaaggagaagccggctagtagtccagttcgctcttccgaagatgtaagccagcgagtctatctctatgagggactactaggaagggacaaaggatccatgtgggaccagttagaggatgctgctatggagaccttttctataagcaaagagcggtctactttatgggaccaaatgcagttctgggaagatgcgttcctagatgctgtgatgttggaaagagaaggaatgggtatggaccagggccctcaggaaatgatcgacaggtacctgtccctaggagagcatgaccggaagcgcctggaggatgatgaagatcgcttactggccacactcttacacaacctcatatcctatatgctcctgatgaaggtgaacaagaacgacatcaggaagaaagtacggcgcctaatgggaaagtcccacgttgggctggtgtacagtcaacaaatcaatgaggtgctcgatcagctgaccaacctgaatgggcgtgatctctccatccgatccagtggcagcaggcacatgaagaagcagacgttcgttgtgcacgcagggacggacacaaatggagatatctttttcatggaagtgtgtgacgactgtgtggtcttacgtagtaacatcgggacagtgtacgagcgctggtggtatgagaagcttatcaacatgacctactgtcccaagaccaaggtcctgtgcttatggcgtagaaatggctctgagacgcagctcaacaagttctataccaagaagtgtcgggagctgtactactgtgtgaaggacagcatggagcgtgcggctgcccggcaacaaagcatcaaacccgggcctgaactaggtggtgagttccctgtgcaggacatgaagactggagagggcggcttgcttcaggtcaccctggaagggatcaatctcaagttcatgcataaccaggttttcatagagctgaatcacattaaaaagtgcaatacagttcgaggcgtctttgtcctggaagaatttgttcctgaaattaaagaagtggtgagccacaagtacaagactccaatggcccacgagatctgctattctgtgttgtgtctcttctcgtatgtggccgcagttcgtagcagtgaagaagacctccgaaccccacctcggcctgtctctagctgatagagaggggttacacagctgggccagcccaggggtcacccctcacctcttgctgctcctaagcgctgaagctgcctcgactgagacagagactctgtgtgtgtgtgtgtgtgtgttctctgcaaggtgttctctgcaagctccttcctgcggttgagctggtttcgttttatgtctgagtgtgtccttgtgttcatctgtcatggggctaagctagtctcattaccttctcttcctacaatagcagac

SEQ ID NO: 2403 - DNA, 494 bp, Rattus norvegicus
  Genbank Accession No. NM_053587
cggcacgagctccttagctttgagcaagaagatggctgccaaaacaggatctcagctggagcgcagcataagcaccatcatcaatgttttccatcagtactctaggaagtatggacatcctgacaccctgaacaaggcggaattcaaagaaatggtgaataaggacttgccaaattttctgaagagggagaaaagaaatgaaaatctcctaagagacatcatggaggacctggacacaaaccaggacaatcaactgtcctttgaggagtgtatgatgctgatgggaaagttgatctttgcctgtcatgagaagctgcatgagaacaacccacgtgggcatgaccacaggcacggcaaaggctgtgggaagtaattaagaggtcgccatgtaacatctgcccaaccaagtctaaagggaatagcttactaaatgaccttggttctggggctgggaaataatttaaaaatgaataaataaagtctttatccattcc

SEQ ID NO: 2404 - DNA, 952 bp, Rattus norvegicus
  Genbank Accession No. NM_053592
ggcctccagcgccatgccgctcttgtgcgcgctgctgcgcagccgactccaaccttctctgctccgctcgcttacgctcacgtccgcgcaaagcctaagctgcggcggaagcagaggagtccggacctggagcgcgcggaccggacccggagcgtgcgctgaccctgcggtctctgtctctaagagggctcgagcggaagatgacgcttctctgcgtttcgtgcggctctcggagcacgctacggctcccacccgcgggtccgcgcgcgctgcaggctacgacctgtacagtgcctatgattatacaattccatccatggagaaagcccttgtgaagacagacattcagatagctgttccttctgggtgctatggaagagtggctccacgttctggcttggctgtaaagcacttcatagatgtaggagccggtgtcatagacgaagattatagaggaaatgtcggcgtcgtgctgttcaattttggaaaagagaagttcgaggtgaaaaaaggtgaccggatcgcgcagctcatttgtgagcggattctttatccagacttagaggaggtgcaaacactggataacactgagagaggttcaggaggcttcggctccacgggaaagaattaaaactttgcttgaagtactttgctgtttgaacactgtaaacgagctttaatttcagaagcattttgtgttctaggatgtaggaaaggatacctatcacggtggaactgctctgttctctagttgatggttgcctgtaaatctgtatcgtgagaactggcagtgacatgcagacttggttattagatattttttttaaatttggtattgtatttaaattatagtcctataagaactgattttgctctaattgctatattatttgtaattttttttttttatccaataagtccgaagtctttagcgaaaaaaaaaaaaaaaaaa

SEQ ID NO: 2405 - DNA, 1232 bp, Rattus norvegicus
  Genbank Accession No. NM_053593
ccgaagcgtccagctgcccgggaccgatccccggtgtatggcgccgcagaaacggctcccgggcccagataaagggcacctccgcagctcttggccgagagatcccctgctccgagaatggctaccactcgatatgaacccgtggctgaaattggtgtcggtgcctatgggacggtgtacaaagcccgagatccccacagtggccactttgtggctctcaagagtgtgagagttcctaatggaggagcagctggagggggccttcccgtcagcacagttcgtgaggtggccttgttaagaaggctggaggcctttgaacatcccaatgttgtacggctgatggatgtctgtgctacttcccgaactgatcgggacatcaaggtcaccttagtgtttgagcatatagaccaggacctacggacatacctggacaaagcacctccgccgggcttgcctgttgagaccattaaggatctgatgcgccagtttctaagcggcctagatttccttcatgcaaactgcattgttcaccgggacctgaagccagagaacattctagtgacaagtaatgggacagttaagctggccgactttggcctagccagaatctacagctaccagatggccctcacgcctgtggttgttacgctctggtaccgggctcctgaagttcttctgcagtctacatatgcaacgcctgtggatatgtggagtgttggctgtatcttcgcagagatgtttcgccggaagcctctcttctgtgggaactctgaggctgaccagctgggcaaaatctttgatctcattggattgcctccagaagacgactggcctcgagaggtctctcttcctcgaggagccttttcccccagaggacctcggccagtgcagtcagtggtgccggagatggaggaatctggagcgcagttgctgctggaaatgctgacctttaatccacttaagcgaatctctgccttccgagccctgcagcactcttacctgcacaaggaggaaagtgacccggagtgaggagaggggctgccttttccagtttccggacgctgtgtggaaagaaccttgctgaagtggcagcctctgccttcccctgaggctatggagagtcctccggtttagccttaaatgacaattccctacctctccttatgaggtttaccccacccccaccctcctgtttctctacactaaagggcaggcattatctgtcttcttcc

SEQ ID NO: 2406 - DNA, 4469 bp, Rattus norvegicus
  Genbank Accession No. NM_053596
cgtgcggtcggagcgtagagctcagcgcagagcaccgggagccggagccttagcgggaggtgcatccaaagcccggccgttcggagcccgcgagcgatgatgtcatcctacaagcgggccacgctggacgaagaggatctggtggactcactctccgagggcgatgtgtaccccaatggcctacaggtgaacttccgcagcccccggagcggacagaggtgctgggcagctcggacctcggtggagaagcggctggtggttctggtgacgcttctggcagcagggctggtggcctgcctggcagccctaggcatccagtaccggacaagaacgcctccggtatgtctgactgaggcctgtgtctcagtgaccagctccatcctaaactccatggaccccacggtagacccctgccaggacttcttcagctacgcctgtggtggctggatcaaggccaaccccgttcccgacggtcactcacgctgggggaccttcagcaacctctgggagcacaaccaagccatcattaagcatctgctggaaaattccacggccagcgcgagcgaggcagagaaaaaggcgcaagtgtactaccgtgcgtgtatgaacgaaactaggatcgaggagcttcgggccaagcccctgatggagctgattgagaagctcggaggttggaatatcacaggaccctgggccaaggacaacttccaggacacgctgcaggtggtcacagcgcactaccgcacctcacccttcttctctgtctatgtcagtgccgactccaagaactccaacagcaatgtgatccaggtggaccagtccggccttggcttgccctccagagactattacctgaacaagacggaaaatgaaaaggtactgactggctatctgaactacatggtccagctggggaaactgctgggtggtggggacgaggactccatccggccccagatgcagcagatcctggattttgagaccgctctggccaacatcaccatcccccaggagaagcgccgggatgaagagctcatctaccacaaagtcacggctgctgagctgcagaccttggcacccgccatcaactggttaccctttctgaatgccattttttacccagtggagatcaatgagtctgagcccatcgtggtctacgacaaggaatacctcagacaagtctccacactcatcaacagcaccgacaaatgcctgctcaacaactacatgatgtggaacctggtacggaaaacaagctcctttctcgaccagcgctttcaggatgccgatgagaagttcatggaggttatgtacgggacaaagaagacctgtcttccccgctggaagttttgcgtgagtgacacagaaaacaacctgggctttgccctgggccccatgtttgtgaaagcaacctttgcggaggacagcaagaacatagccagcgagatcatcctggagatcaagaaggcattcgaggagagcctgagcaccctgaaatggatggatgaagatactcggaggtcagccaaggagaaggcggacgccatctacaacatgataggctaccccaacttcatcatggaccccaaggagctggacaaagtgttcaatgactacacagcagttcccgatctctactttgagaacgccatgcgatttttcaacttctcattgagggtcacagccgaccagctcaggaaagcccccaacagagatcagtggagtatgaccccgcccatggtgaacgcctactactcgcccaccaagaacgagattgtgtttccagctggaatcctgcaggcgccattttatacccgctcttcgcccaacgccttgaactttggtggtatcggggtcgttgtggggcacgagctgactcatgctttcgacgatcaaggccgggagtatgacaaggatgggaacctccggccctggtggaagaactcgtcggtggaggcattcaagcagcagaccgagtgcatggtacagcagtataacaactacagtgtgaacggagagcccgtgaatgggcggcacaccctcggggagaacatcgcggacaacgggggactcaaggcagcctaccgggcgtaccagaactgggtaaagaagaacggagctgagcagatactgcccaccctgggtctcaccagcaaccagctcttcttcctgggattcgcacaggtctggtgctcggtccgcacaccagagagctcccacgaaggcctcatcaccgatccgcacagcccctcccgcttccgggtcatcggctcactctccaactccaaggagttctcagaacacttccgctgcccgctcggctcccccatgaaccctcgccacaaatgcgaagtctggtaagggctgaagcgcagagaacacaggtggaagaagggaaggggcctgcagccagctcccgggaacagggccgcgctgtcaccctccttccagcccctcggccgagggccccttccccaccctggagggtatgcagccatcttgtctaagcctatgccagaggctcagcactggaagccaacatttgacccccttcgaagctccagcatcccagacacccttgagtgatgctataccgggcctttgggtgtgtcaagctggtggcttgccagccctgggcctcacactgacaatggcagtgggacaggaccctttgccacgtccaatgccagatataccacaataccactgtgtcaaatgctttaaagatatattttttggggagactattttttaagcattatggaatacactggaaatcttcagggaaaatgcatttaaaacacttttttttaaaaaaagattagtatatttattatgttctctcttttttttctaaacaacctgcggacaaaggaaaccccactgattgaccccaggggaccccaggctgttgagcaggccaccagtttgagcactgctttagcccattgttggtgtaattgcttgtgcagtcaggagatgtaggggccaggcagaaggggtggccagctgaagggcctgatttatgagcatggccttctctgtcctgtctccggagtccaaccatgggaaccccaacaaggacgggctgttacccaagttgatccctatggcagtacaaagccagagtaatggcctccgtacaaccgggggacccctgaacactctggacaacatcacaggagcccgtcggggctgagaccccacaccccatcagatgcacactattgtccaaagatgtcttgttttggtcccacctcttctggccttgggaccggttgcctctctgtagcagttctgacatcctgaagtggtcgccctctgtaccaggggaaaggggaaagagaaagcagtccagttctccctccaagctccgtagcctgtagttaccctggcttggctcctgggaccccttctctagtgccttaccccaggccacagcccctgagcccctttgaggaggcagcatttgtcttgctttctcagtggagcccccaagtgtcctgactagaagccaacaccatagccccactcccagaagccccagggtaccgtcccaaaccctacaggacagccattccacacattccccaccccacccccctctgcagcaggccaagactggaaggttcccagccccatcgggctccagggaatggcaggatgtcatccacccacagcatcacctaacagatatgtgggcctccactaagtggcgctcactgaggttttcatgactgctgtagggagcaagctcttgtgacctgtgtgtgaggagcgcagtagaagtgcccatcacagcccctggcaagtcatgcccccacatagcacaacacacacacacactcacctggaagccagagtcctccttggccaagacgcagagacagtgtagtctcggtcctgctagcgtagcgatagtcttagcactgggatggggagctgcaagcgggtgtctggcaaggttcttggtccctgtgaacacattcgaggtctcagctcttcggggaaaagtaacacaggaagcaggaaggtgctggagccacgccctgccacacaggggggaccttctgggtgggatcatctgccctttctatcccctcgccctgcttccccacaggtggccgtcctggatgccagtatctagaagcagggtcctgagctggagttagccatgcacgcattgctcagggtgtgcagggagccaaggcaggaaaacccaggctggttagggatggatgggtgcaaaagcagcatcccgacccctgtccctccagagatttgagaagggcagaattaggaagggcacccgccctcagaaagagccctcctctcaagcccggagtttccctgcaggcacaaggacatggggtttggaactggggactctatttttttgtattattgtgttttgtgctactgtagttttggtgtggcacctattataattaaaataaagtacttatacc

SEQ ID NO: 2407 - DNA, 336 bp, Rattus norvegicus
  Genbank Accession No. NM_053597
cggcacgagcgacctccctacgagaacatgcctctcgcaaaggatctccttcatccttctccagaagaggagaagaggaaacacaagaaaaagcgcctggtgcagagccccaattcctactttatggatgtgaaatgcccaggatgctataaaatcaccacggtctttagccatgcacaaacggtagtcttgtgtgttggctgctccactgtactctgtcagcctacaggtggaaaagcaaggctgacagaaggatgctccttcaggaggaagcagcactgaaagcccctgattcaagatgagtgggaacgttcccaataaacacattttggatat

SEQ ID NO: 2408 - DNA, 1444 bp, Rattus norvegicus
  Genbank Accession No. NM_053606
ccagacaggctagccggttcactacttgagccagtgcctccgagtcctcaccccaccataaggctgtaactcgagccgtccgccgcccacccccttcccactccgccccagctctgcgatccaggtccctacgtcgcgcggccccttgtggccctaactcgactgcaaatctgccatgggctggcgggcctgtctccgtccggaggcgtccggcgctgtacagggccgctggttgggggctgtcctgagcgggttgtgtcttctctccgcgctggcgttcctggaatggctagggtcgccgacagagaccgcctggaatgcagctcagggaaatgtggatgcgccagatgtgggcggctccactccccaggtacccagcctattgtccatgctggtaacccgaagacgccgctacacgctgacaccggccaggctgcgttgggaccacttcaacctcacgtacaggattctctcctttccccggaaccttttaagcccggaagagactcggcggggcctggcggctgcctttcgaatgtggagtgatgtttccccattcagcttccgtgaggtggcccctgaacgtcccagtgacctcaagataggtttctacccagttaaccacaccgactgcttggtctctgccctgcaccactgcttcgatggtcctacaggtgaactggcccacgctttcttcccaccccacggtggcattcattttgatgacagcgagtactgggtcttgggtcccacgcgctacagctggaagaaaggtgtttggctcacagacctggtgcacgtggcagcccatgagattggccatgcactgggactgatgcactcacagcaagaccaggcactcatgcacctcaatgccacattgcgaggctggaaggcactgtcccaggatgagctgtggggactacaccgactctatggctgcctggaccggatttttgtgtgtacatcctgggcacgaaagggattttgtgatgtccgccagaggctcatgaagaggctctgccccagaagctgtgatttctgttacgaattcccatttcccacggttgccaccaccacatcacccaccagaacgaaaacgaggttcgtgagagagggtaggaacatgaccttccactgtggacagaagatcctacacaagaaaggcaaagtatactggtacaaggaccaggaacccctggagttctcctaccctggctatctggccctgggtgaggcacggctgagcatcattgccaatgcagtcaacgaaggcacctacacatgtgtggtacgccaccgccagcgtgttctcaccacctactcctggagggtccgagtgaggagctgagccagctccagcctctgtgctggaagccagcagataaagcactttctctctgaaaaaaaaaaaaaaaaaaaaaagaaaaaaaaaaaaaaaaaa

SEQ ID NO: 2409 - DNA, 978 bp, Rattus norvegicus
  Genbank Accession No. NM_053615
atggcgagcagcagcggctccaaggccgaatttatcgtcggtgggaaatacaaactggtgcggaagatcggatctggttccttcggggacatttatctagcgatcaacatcaccaatggcgaggaagtggcagtgaaactagaatcccagaaggccaggcatccccagttgctgtacgagagcaaactgtataagattcttcaaggtggggttggcatccctcacatacggtggtatgggcaaggaaaagactataatgtgctagtcatggatcttctgggacccagcctcgaagacctcttcaatttctgttcaagaaggttcactatgaagactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagggaagataaaaacctcactggcactgcccggtatgccagcatcaatgcacatcttggcattgagcagagtcgccgagatgacatggaatctttaggatatgttttgatgtattttaatagaaccagtctgccatggcaagggctaaaggctgcaacaaagaaacaaaaatatgaaaagattagtgaaaagaagatgtccactcctgttgaagttttgtgtaaggggtttcctgcagaatttgccatgtacttaaattactgtcgtgggctgcgctttgaggaagctccggattacatgtatctgaggcagctgttccgcatcctcttcaggaccctgaaccaccagtatgactacacgtttgattggacgatgttaaagcagaaagcagcccagcaggcagcctcttccagtgggcagggtcagcaggcccaaacccccacaggtttctaa

SEQ ID NO: 2410 - DNA, 4862 bp, Rattus norvegicus
  Genbank Accession No. NM_053623
gccgaggctcgcccctccttgcaaggctgctccagagctagcgggcacgcgagctcctctccgggagcttccttccccgaaaggccgggacccagtggcggactcgtggtgagcgaggcagcaccttcgatcccaggagattgacctgttcttaaaagtgaaagaagaaatctaagaaaaacgctatggcaaagagaataaaagctaagcccacttcagacaaacccggaagtccatatcgctctgtcacgcacttcgactcactagctgtcatagacatccctggagcagatactctggataaattatttgaccatgctgtagccaagtttgggaagaaggacagcctggggacccgggagatcctgagcgaagaaaatgaaatgcagccaaatggaaaggtttttaagaagttaattcttgggaattataaatggataaactatcttgaagtgaactgccgagtgaataactttggaagtggcctcactgcactgggactgaaaccaaagaacaccattgccattttctgtgagaccagggcggagtggatgattgcagcgcagacctgctttaagtacaactttccgcttgtgactttatatgctacccttggcaaagaagctgtcgttcatggattaaatgagtctgaggcttcctatctgattactagtgttgaacttctggaaagcaaactgaaggcggcattattagatatcaattgtgttaaacatatcatttatgtggataacaagactatcaatagagcggagtaccccgaggggcttgagattcacagcatgcagtcagtagaggagctgggatccaagccagaaaactcaagcattcctccaagtagaccaactccttcggacatggccattgtcatgtacaccagtggctctactggccgccccaagggagtgatgatgcaccatagcaatctgatagctgggatgacaggccagtgtgagcgcatacctggattaggaccaaaggacacatatattggctacttacctttggctcatgtgctggaactgacagcagagatctcctgctttacctacggctgtaggattggatattcgtcaccactcacactgtctgaccagtccagcaaaatcaagaagggaagcaagggtgattgtactgtactgaaacctacacttatggcggccgttccggaaatcatggatagaatttacaagaatgttatgagcaaggttcaagagatgaattatattcagaagactctatttaaaattgggtatgattataaattagagcaaatcaagaaaggatatgatgcccctctttgtaatctgatactgtttaagaaggtgaaggctcttctaggaggaaatgtccgcatgatgctgtccggcggtgccccactgtccccccagacacaccgattcatgaatgtctgcttctgctgccccattggtcagggctatgggctgacagaatcatgcggtgctggaacagttactgaagttaccgactacactactggaagagttggcgctcctcttatttgctgtgaaattaaactgaaggactggcaggaaggtggttatacagttcatgataagccaaaccccagaggtgaaattgtgattggaggccagaatatctccatgggatattttaaaaatgaagagaaaacagcagaagattattctgtggatgaaaatggacaaaggtggttttgcactggtgatattggagaattccaccctgatggatgcttacagattatcgatcgtaagaaagatctggtgaagctgcaagccggagagtacgtgtctcttgggaaagtcgaagccgcactgaagaattgtccactgatcgacaacatctgtgcttttgccaaaagtgaccagtcttatgtgatcagttttgtggttcccaaccagaaaaagttgactcttttggcacaacagaagggggtagaaggatcttgggttgatatttgcaataatcctgccatggaagctgaaatactgaaagaaattcgagaagctgcaaatgccatgaaattggaacgatttgaaattccaatcaaagttcgattgagcccagagccatggacccctgaaactggtttggtaacagatgccttcaagctgaaaaggaaggaactgaagaaccattatcttaaagacattgagcggatgtatgggggcaaataaaaggcaactgtctacttcacatttgcacaggaggtggcctgatggtttttttagttctagagtttaagcctttgttgatctctctgttaaaatgtaaggtgaatcttctaaagacatgaaacaaaaaaacaaccaaaagtggttacaataaattgcatagtcctagagaagctgaaattgaagacatttccctttagctgtgttattaagtttagagcaaaaattctgttttagaatattagccttagctacacttgtttttctaaagatactccatgctaaagtaaacaaattggacttggactaggtgtagttgaagaaatctacagcttccagtgtctatgtcttcctagttcagaagtttctatcgtaatcattaggacaaaattacgtattaacactactcaaagccgaagttccaccaggctttgaaatcctcttccaaccatttctcttgaagggaaaaaaatcagttgtaataaatggattcagtatcttagaaggtattattttaagctcataattgccatgtaggtgagacatagaatcattataatattgtgaataattacagtgcctgaagttaaaactaaaacaacacacacataccaaaaatatctcataatgtatttgaagggaggctgaattgctcctttggatgtctaagaacttaaatcagcaactgtaattattgaaatgtcttcagaaaaatgtccactttgtaaaagtgacctttctgtgtgtgatctagtcaaaggctgagaccaaggggaacatgttagaaagtcaatcagaattcaataagatacattgcttttctgttagaaagttcatggcatcctaagcattcagaattaggatcctggcatagcactgagcctgggaaagagatttagcctctttaactttgataccagggcttgattttaaaatgtgcttgtattaaattacatttgtaatttatggtctgtttgctgttgctgattgattcttgatcagtagtgtgcatttcagagagcctttcattttgctttaatttcagcaaagcgggttatgataaatgacttcctcgaatcttgttcaaacctacgggtgattaagtgtcttggatgagtctgaggaagttaaagggaagaaaacactgttaacacttttcctgtttgtgaagagtttagaaactggaaatgctagatttgggagaagggcagagttacttgattaaggactgtctgtgcagtaacttgggagtgtgagtttctttttaaatcttcagctaaaatctggaattatatattcttgatagatattcgcacttgaaccatagttactgtatgtaaaaagcaaaaattcttaatactgttattctttgcacttttttcatagtcattttatacacacacacacacacatgcatgtgtatgtgtgtgtgtatatataatatatatatgttgcttacattgtgttgtacagatgtgggccaccactacaacaaaatgagttctttgtgctctaaaatatttataaagaaattatttaaatgttatgtatatggtggtaatattgagaaaaaaaatcatctggtattctgagcaacagcgaaggtttttgtaaaagtttcttttcagtgttgtgcaaactaaaatttgaggcaagttttccctgaagttctatgtgagtattctcatgcttcccatcttgcctttgaagtgtgaaaagacatcaagtagactactagtcagcttctacctactcctagtgcactgtttatccgtttttttttaaaggcttttccaatatatgtatcccatttggaatggtgattttaaaatgtgagtgcatgcagactatcttacttaagatacttgcaccccacccacagccatctcccaaagctggaacactgccaactaggtccttaagaatcacgcattgaatacaaggtcgggtgctgctaattcttcatgaaaatcctaacacacacgttaagggaccagggagatgccactgccctctgacttttcatcaaaaaaaaaatatatatatacatgtttatgtaaacagaactattttccatattcatagtgactttttaagtatttgagcctaaaggttttgatctccattttatacctatttaaatcgttcacaatttcatgtcagccatcaattaaagctgtgcttactgttgattgtgtgtgcatttctaaggtgaacgctcctaattttttgctttaattacatgaaagggtcttatttctttgatatttgtgctcttttttttaatgtagactgaaggtatgattgtgtgacttttaagaaatgaaataccgatgaatgatccatagagtccaaagtgagggagaatgctgtttctttgttcatagagactgactagtaatctttgcctatattttcctggtagcagatgacaaatgtttctacagtgacaagctgagaagaggttaaaggttaaagattgtgtggcattcgggaactggagagatacgttttaattttgaatgtagttacaaattttatattcatatttgtactttctgttaatgcacgattgtagaattgttctgtagattttttgtgtttactcttgaaaggctttgtttgttcttctttttaagtttgcacttgaatcttataaaataaatc

SEQ ID NO: 2411 - DNA, 2619 bp, Rattus norvegicus
  Genbank Accession No. NM_053625
ctgaccttcctcccggaagtgctcctgtggctggagttgccggcgtgactttgagcgcttcccgctctgctgccggcgctgagcacaacagagcacagcgacgaggaaccctggaagtggctgttccagacttgtcatgcggctgctgcggatcactgcaggcctggggcgtgggccgctccctcgggtccctgccatcctgggttggcaggggaagcaggctaattggaagacctaccgatggtgttcgtcaggatcaattcccaatgagaaaatccggaacattggaatctcggctcacattgattctgggaagacgacgttaacagaacgggtgctgtactacaccggcaggattgccacgatgcacgaggtgaaaggtaaagatggagtcggtgctgtcatggactccatggagctagagagacagcgagggatcactattcagtcagcagctacctacaccatgtggagagatgtcaatatcaacatcatagacactccaggccacgtggacttcacaatagaagtggaaagggccctgcgagtcctggatggtgcggtccttgtcctctgtgcagtcggtggagtgcagtgccagaccatgactgtcagtcgccagatgaagcgctacaacgttccctttttaaccttcattaacaaactggaccgaatgggctccaacccagccagggcccttcagcaaatgagatccaaactaaatcacaatgctgcatttgtgcaaatacccattggtttagagggggattttaagggaattatagacctcattgaagaacgagccatttactttgatggagactttggtcagattgttcgatatgatgagattccggctgatctgagggccgcagcagctgaccaccggccagagctaattgaatgtgtggctaattcagatgagcagcttggtgagctgtttctggaagaaaaaatcccctcagtgtctgatttaaagttagcgatccggagagctactctgagtagatcctttactcctgtgttcttgggaagtgctctgaagaacaagagagttcagcctctcctggatgctgttttagaattcctccccaatccatctgaagtccagaattacgctctactcaatcagaatgatttaaaagagaagaaaaaaatcctaatgaaccccaaaagagacgactcgcacccgtttgtaggcctggcttttaaattggaggcaggccgtttcggacagttaacttacgtccgcaattatcaaggcgaactgaagaagggaagcaccatctacaacacgaggacaggaaagaaagtgcgcgtgcagcggctggtgcgcatgcatgccgacatgatggaggatgttgaagaagtatatgccggagacatctgtgcgttgtttggcattgactgtgcaagtggagacacattcacaaacaaagacaacagtgacctttctatggaatcgattcatgttcctgatcctgtcatttcagtagcaatgaagccttctaacaagaatgatctggaaaaattttccaaaggtattgccaggtttacacgggaagacccaacatttaaagtccactttgacacagagagacaaggagacgattgtgtctggaatgggagaattgcacctgagatctatgctcagagaatggagagagaatatggctgtccttgtatcacaggaaagacccaaagtggacgtttagagaaaccgttactgcccctgtgccatttgattttacacataaaaagcagtcgggtggtgccggccagtatgggaaaagtgataggggtgctggagcccttggccccggaggacctaccgaagttggagttttccgatgagacctttggggccaatgttccaaagcagtttgttcccgccgttgagaaggggtttttggatgcctgcgaaaaagggcctctttctggtcacaagctttctgggctccggtttgttctgcaagatggagcacaccacatggtggattctaacgagatctctttcatccgagctggagaaggtgctcttaaacaagccttggccagtgccacattgtgtattattgaacctatcatgtccgtggaagtcatcgccccaaatgagtttcagggagcagtgtttgcaggaattaaccggcgccatggagtgattacagggcaagacggaattgaggactatttcacgctctacgctgatgttcccctaaataatatgtttggttattccactgagcttaggtcttgcacagagggaaaaggagagtacacaatggagtacaacagataccaaccatgttccccatccacacaagaagagctcgtcaataagtatttggaagctataggtcaacttcccgtaaaaaaaggaaaagccaagaactgactctcagtggtactttgaacgtactgacagtttgactacaagacgtaaggatgatggatgccggtagaatgaatttagacggctgaaacagatttaggagcccctgccatctcgtgttcaggagcttctatatacgtgcaagataactagataactatgtgtatttaaactgtatttttattatttagtaaaagatcttaaataaaattatattattggaattc

SEQ ID NO: 2412 - DNA, 3736 bp, Rattus norvegicus
  Genbank Accession No. NM_053630
caggcagcggcggcgagaggaggggaggaggcaggccggcgcatggggcgccccggccccgccggtagcgcgccccctccggccaggccgcgctgaacgcagcccgcgcaacgcctcgaattcgtacccggggccatgccggtcatgaaggggttgctggccccgcaaaacacctttctggacaccatcgccactcgctttgacggcacgcacagcaactttcttctggccaatgcccagggcccacggggttttcccatcgtctactgctctgacggcttctgtgagctcacaggctacggccgcaccgaggtcatgcagaaaacctgtagctgccggttcctctatggcccagagaccagtgagccggccttgcaacggttacaaaaagccctggagggccaccaagaacacagagctgaaatctgcttttaccgaaaggatggctcggccttttggtgtcttctggacatgatgcccatcaaaaatgagctgggggaggtggtgcttttcctattttcctttaaggacatctctcagagtggaggcccaggacttggctcaccagggatccatggggacaataataatcatgaaaactcccttgggaggagaggagctagctcaagacttaggtccacgaggaggcagaaccggacagttctacaccggttgactggccactttggtcgccgggaccagggaagcgtgaaagccaatagtaacgtgtttgagccaaagccatcagtgcctgagtacaaagtggcctccgtggggggctcccgctgcctgctcctccactacagcatccccaaggctgtctgggacggtctcatccttctcgctacgttctacgtcgcggtcaccgtcccttacaacgtctgcttcgctggtgatgacgacacccccatcacgtcccgacacacccttgtcagtgacatcgctgtggagatgctcttcatcctggacatcatcttgaacttccgcaccacctacgtgtcccagtcgggccaggtggtttctgctcctcggtccattggcctccactacctggccacctggttcttcgtggacctcattgctgctttgccctttgacctgctgtatgtcttcaacatcactgtgacctcgctggtacatctgctgaaaaccgtgcggctcctgcggttgctgaggctgctgcagaagctagagcggtactctcagtgcagcgcggtggtgctcacgctgctcatgtccgtctttgcactccttgcccactggatggcctgcgtctggtatgtcatcgggcgccgggagatggaggccaatgacccgctgctctgggacattggttggttgcatgagctgggtaagcggctggaggagccttatgtcaatggctcggccggtggaccatctcggcgcagtgcctacatcgccgcgctgtacttcacgctgagcagcctcaccagtgtaggcttcggcaacgtttgtgccaacactgacgctgagaagatcttctccatctgcacgatgctcataggcgcgctgatgcacgcggtggtgtttgggaatgtcacagccatcatccagcgcatgtactcccgacgctcgctctaccacagccgcatgaaggatctcaaggacttcatccgagtgcatcgtctgccccgcccactcaagcagcgcatgctcgagtacttccagactacatgggccgtcaacagcggcatcgatgccaacgagttactgcgtgacttcccggatgagctgcgagctgacatcgccatgcacctgaatcgggagatcctgcagctgcctttgtttggagcagcaagcaggggctgccttcgtgccctctccctgcacatcaagacctcattttgtgctcctggggagttcctgctacgccgtggggatgccctgcaggcacactactatgtctgctctggctctcttgaggtgctccgagacaacacggtgctggccatccttggaaagggggacttgattggggcagacatccctgagttggggcaggagcctggggcaggggcaggctgcgtgctgaagaccagcgctgatgtgaaagcactgacttactgcggcctgcagcagctgagcagccgagggctggccgaggtccttcggttgtatccggaatatgtggctgccttcagggctggcctaccccgggacctaaccttcaacctgcgccaaggctctgaaaacaatggcctcggccgcttctcacgttctcctcgactctcccaggcacgctccgacactcttggttcctcctcagacaagactctgccatccatcacagaaaccgagggtggcatggagcctggggctggttccaagccccgtcggcccctcctgctgcccaacctcagtccagcacgacctcgggggtccctggtcagccttttgggcgaagagctgcccccattctcagcccttgtctcctctccttccctgtccccaactccttcccctgccctggctggccggggttcaagtccctccctgcacgggccccccaggggctctgctgcctggaagcccccccagctcctcacccccccactgggaacatttggacctccggacctcagtccccggatcgtggatggcattgaggactccagtaacacagctgaggctcctacattccggttcagcaagaggccggagcccaccagaacccgttcacaggctcccctttcaggccctaggctcagccgggaactggccacagaggcagcagaggaggtgaaggaaaaggtctgcaggctgaaccaagagatttccagactcaaccaggaagtgtctcagctgagccgggagcttcgccaagtgatgggcctcttacaggccaggctgggtcccccaagtcacccacctgactccacttggctcccagaccttccttgtccccatcagagaccgccatgcatctctcctcatatgtctggacctccacctggtctccagaatactacacttgctgtagtccactgtccagccagtgttgggacagtggagataggggccaccccctcagagctgaggtcttccatggtgccaccctttccctcagaacctgatcctcttggaccctctccagtgccagaggcttctcctctgaccccaagcctcctgaagcacagcttccagtctgggtcagacacattccactgaccctggccttgggcccaggcctgtctggggtgggcttaattacctgccatccagggaggagctgggctccttggcctcttgccttggggtcagcagctgccagctggtctggttggctctggattctctggactttttaacaatgagtggccacatctaaccccgttccattttctaaaccatcccccccacccgtcctactcttgtgggaggggagtcacctgaagccgtggaatccagcaggcatgaaatggaccatggtgccctgttgggctacgcagaggagatgtcttactttctccccacgacttggaggctgtcatgcaaggtggtcccttctgctgccagcagctcaaagcattctagctttacccttctgcagttcccacctccaaacatcagtcatatctgcccccctccctcccaacatggtctcgacctcaatgaggatctgggcaactcacaaaccctctctggtttccagctcccctttctcactaaacaccccaggctcacttttggatagaaaataaatccatatattttt

SEQ ID NO: 2413 - DNA, 2976 bp, Rattus norvegicus
  Genbank Accession No. NM_053633
gcgattcattaattgctgggcgaggggacacactgactgttataataacactacatcagcaactcctggctccccaacagccggatcccaggcaggagagagtcagtggcagatagccatttttttttcttccttaagaagccaacaacttggttgctagttttatttctgttagaatttttttttttgtgtgtgtgtggatgtgtggtggtggtggtcttttctaagtgtggagggcaaaaggagataccatcccaggctcagtccaacccctctccaaaaacggcttctctggcactccaggtagcgagggagttgggtctccaggttgtgcgaggagcaaatgatgaccgccaaggccgtagacaaaatcccagtaactctcagtggttttatgcaccagctgcctgacagcctctacccggtggaagacctcgccgccccgtcggtgaccatcttccccaatggtgaactgggaggcccctttgatcagatgaacggagtggctggagatggcatgatcaacattgacatgaccggagagaagaggcccttggatctcccatatccgagtagcttcgctcccatctctgcgcctagaaaccagaccttcacttacatgggcaaattctccattgaccctcagtaccctggtgccagctgctacccagaaggcatcatcaatattgtgagtgcgggcatcttgcaaggggtcacccctccagcttcaaccacagcctcttccagcgtcacctctgcctcccccaacccactggccacgggacccctgggtgtgtgtaccatgtcccagactcagcctgaactggaccacctctactctccaccaccacctcctcctccttattcgggctgtacaggagacctctaccaggatccttcagcattcttatcgccgccacccaccacttccacctcctctctggcctaccagccacctccttcctacccatcccccaagccggctatggacccaggtctcattcctatgatcccagactatcctggattttttccatctccgtgccagagagatccacatggcgcggctggccctgatcgaaagccgttcccctgccctctggactccctgcgggtcccccctccgctcacgccactctccaccatccgtaattttactcttggggggcccagtgctggcgtcacgggaccaggggcaagtggaggcggtgagggtccccgactgcctggcagtgggtctgcagcagtgactgctaccccctacaatccgcaccacctgcctttaaggcccatcctgagacctcgaaagtaccccaacaggcccagcaagacgccagtgcacgaaaggccgtacccctgcccagcagagggttgcgacaggaggttctcacgctctgatgagctgaccaggcacatccgaatccacaccggtcacaagcccttccagtgtcggatctgcatgcgaaacttcagccgaagtgaccacctcaccactcacatccgcacccacaccggggagaagccctttgcctgtgactattgtggccgtaagtttgcccggagtgacgaaaggaagcgccacaccaagatccaccttcgccagaaggagaggaagagcagtgccccctcgtcatctgcatccgcccagtcttcagcctctggtcctgggggctcgcaggccgggggcagcctgtgcggtaacagcgccattggaggaccactggcctcctgcacctctcggaccaggaccccgtgagatgaagctccagctgacacaccagtttcttcaggccccagaggccctctatccactcgagctgcaaacactaccgcccttctgtgttcttccccgtgatcccgtgaacctgtgatcctgggcaaaggaccctaatggagcccagctctgtcccaccttctcacagacggccttctgaaaacttaggccattttaaaggagttgactgtcactccaagaaatggggagccagaagagggctgggcgagggcccctggcctacagggctgtgctctaaccctgacagagagatgtttgactatggtctgcgagcccttccctttgaccctcgatgccagttgctctgagactttttctacaataggttgggagttgttgattcctttgagcaaggacagcgaaaaagactaaattaaagcaaaaccgatgtggcactttaatggcttgggacggacttggggtaggggtggggggttgtacagtgagcacagtttagccctggcctggccgcagcactctgtggccctagaacagtgaatggaagtttctcgagccatctcagcccttaagcaatatgtcctataaactcaagagaacgaacggaagtgcaatgtcgggaaggacaaagcaatattggctcctttttgttgagaaacaaagattatttttccagtgtatatccatttagatttttgtgtattttttttttttgatgtgcactgttctccgagttctgaacctttgggaaaaaagtgtaaaacatttatgatctcttgaatcgagtcaaaagttaacttatttaaaggggggtgtacataggatgcatgcagtggtgttgcaagtgtcctctgtgccttgtgtgatgtgggcagtgttacagggtctgcatgtgtacaggatgccttactatgaaaaaaaaatcactccctgggtttaagtatggctgtatatttctgcctattaatatttggaatttttttagaaagtatatttttgtatgctctgttttgtgacttgaaagtgttaccttcgcagtcaaatttcagatgagagtgtgcttaacgtcactgcagctgacttgtttggttattagctcttaatagttgtggaaagattaaacaatctattctaacacagaaccactaactggagttcagatatcggacggcttatggcaatggtgtaaaataaatacttttcaacaataaaaaaaaaaaaaa

SEQ ID NO: 2414 - DNA, 2207 bp, Rattus norvegicus
  Genbank Accession No. NM_053648
cattttagaggcactatttctagtacaatgggtatgaagctgtgatttgagccgcaaatttcagagcattggccatagaacagacctggtcggtttgatgtcactgtagcttggtttaggcggccggggattgcgtcggtttttaaccctagtgaagggacggctcatgagtgcaggacgtcttcggatgagattagtatacgaattggaagttctattggtaagactacccgattatcaacttctaatagacgaagctcacctggttttaggtcgggacagatggaggcatcaaggagcagagggcaggaagacaggacgctttgagcacacggggctttgtgtctattccactgacaacctcctcactgccacccaccggttccatggagataatatttggccggaataagaaagaacagctggagccattacgggccacagtgacaggcagcattccagcatggctgcaggggaccctgctccgaaacgggcctgggatgcacacagtgggagacagcaagtacaaccattggtttgatggcctggcccttctccacagtttctccatcagagatggggaggtcttctacaggagcaaatacctgcagagcgacacctacaacgccaacatcgaggccaatagaatcgtggtgtctgagttcggaacaatggcctacccagacccctgcaaaaacatcttttccaaagctttctcctacttgtcccacaccatccccgacttcacagacaactgcctgattaacatcatgaaatgtggagaagacttctatgccaccacagagaccaactacatcaggaaaatcgacccccagactctagagaccttggagaaggttgattaccggaagtatgtggctgtaaacctggctacctcacaccctcattacgacgaggctggaaatgtccttaacatgggtacctccatcgcggacaaaggagggacaaaatacgtgatgtttaagatccccgccacagcaccaggcagcaagaagaaagggaagaaccccttgaagcactcagaagttttctgctccatcccgtcccgctcgctgctctcccccagttactaccacagctttggagtcacggagaactatgtggtgtttctggagcagccttttaagctggatatcctcaagatggccaccgcatacatgaggggtgtgagctgggcttcctgtatgacattctgcaaggaggacaagacttacattcatatcatcgaccagaagaccagaaagcctgtgccaaccaaattctacacagaccccatggtggtcttccaccatgttaatgcctatgaggaggacggctgtgtgctgtttgatgtcatcgcctatgaggacaacagtctctatcagctcttctacctggccaacctgaacaaggacttcgaggagaagtccaggctgacctcagtgcctaccctcaggaggtttgctgtgcccctccacgtggacaaggatgcagaagtgggctcgaatttagtcaaggtgtcatctacaacagcaactgccctgaaggagaaggacgaccatgtctactgccagcctgaggtcctctacgaaggcctagagctccctcggataaattatgctcacaacgggaagccatatcgctacatctttgctgctgaagtacaatggagtccagtcccaaccaagatactaaaatatgacgttctcaccaagtcctccttaaagtggtccgaggagagctgctggcctgcagagcctctgtttgtccccacaccgggtgcgaaggatgaggatgatggagtcatcttatcagccatcatctctacagatccccaaaagctgccctttttacttattctggatgcgaaaagttttacggaattggctcgcgcctctgttgatgtggacatgcacctggacctgcatggtttatttattccggatgcaggctggaatgcagtgaagcagactccagccaaaacgcaagaggatgaaaattcagatcatcccacaggtctgacagcaccaggattgggccatggtgaaaatgacttcacggcaggtcatggcggcaagagcctttaatcctagcactcgaggcagaggcaagcagatctctgagttcaaggccagcctggtctacaacacaagttccaggacagccagggatacacagagaaatcctatcttgaaaacaaagcaaag

SEQ ID NO: 2415 - DNA, 3845 bp, Rattus norvegicus
  Genbank Accession No. NM_053655
gtctgcagaggatggagcttacttattcagagttaaagatgtctccagcctgggaggctgagagtggaaattcaccggctcagcggttagtcaggagtgaatccctgcaggaaagccccgcctgcctaggctcagcaggtcactcattcgctgactcagtcgcttagcaaacacagtgttcaccacccacacgctaggccatgcatctagactgacatggcccctgccctactgaggggcagacactgcctccagggaggctcacttgctatgggcttgctttcttcccaagggctactgttcaaggaactcttgtgttgaccacaggctgaggcttccaacaacttctccaaattcacacagtagagaacaggccatgatgctctttcctgcagccagacccctgacatggggtgagagaacaggtgagcaggccagagtcagtgtccgggcccagcagctgccttttgggaagtcagttctgagtagacgggcctggttaaaatcctggcgatgccattttctggttgtgaccttgcacaggtcatcccctctctgagcacctgtttccctcctctataagtaagtggtgacaagactcagtttttcttccctaaggtgtccgaaaaggggagggccacagctcctcgtgccgaattcggcacgaggcgggctgcgggctgcgtccccattcattgcagtggtctgctgggttggggtccagtgtttccggagtcatggaggcgctgatcccggtcatcaataagctgcaggacgtcttcaacaccgtgggcgccgacatcatccagctgcctcagattgtcgtagtgggaactcagagcagtggaaagagctcagtgctggaaagcctagtggggagggaccttcttcccagagggactggtgtggtcacccggagacctcttattctgcagctggtccacgtttcaccagaagataaaagaaaaacaacaggagaagaaaatgaccctgctacatggaaaaactcaagacacctttctaaaggagttgaagcagaagaatggggtaaatttcttcacaccaaaaacaagctttacacagattttgatgaaattcgacaagaaattgaaaatgaaactgaaagaatttcaggaaataataagggagtaagccctgagccaatccatctcaaggttttctcgcccaacgttgtcaacctgacgcttgtggatttaccaggaatgaccaaagtacctgtaggtgatcagcccaaggatattgagcttcaaatcagagaacttattcttcggttcatcagtaatcccaattccattatccttgctgtcactgctgcaaatacagatatggcaacgtcagaggcacttaagatttccagagaggtagatccagatgggcgcagaactctagctgtaatcaccaagcttgatctcatggatgcgggtactgatgccatggatgtattgatgggaagggttattccagtcaagcttggaataattggagtagttaacaggagccaactggacattaacaataagaagagtgtaactgattcaatccgtgatgagtatgcttttcttcaaaagaagtacccatctctggccaacagaaatggaacaaagtatcttgctaggactctgaataggttacttatgcatcatatcagagactgtttaccagagctgaaaacaagaataaatgtcttagctgctcagtatcagtctcttctaaatagctatggtgagcccgtggatgataaaagtgctactttactccagctcattaccaagtttgccacagagtattgtaacactattgaaggaacggcaaagtacatcgaaacttctgagctatgtggtggtgctaggatttgttatattttccatgagacttttgggcgaaccttagaatctgttgatccactaggtggccttaacactattgacatcttgactgccattagaaatgctactggcccccgtccagctttatttgtgcctgaagtttcatttgagttactggtcaaacgtcagattaagcgtctagaggagcccagcctccgctgtgtggagctggtccacgaggaaatgcagaggatcattcagcactgtagcaactacagcacacaggaactgttacggttccctaaactccatgatgccatagttgaagtagtgacttgtcttcttcgtaaaaggttgcccgtgacaaatgaaatggtacataacttagtggcaattgagctagcatatatcaacacaaaacaccccgactttgctgatgcctgtgggctaatgaacaataacatagaggaacaaagaagaaacagactagcaagagaactaccttcagctgtatcgcgagacaagtcttctaaagttccaagtgctttggcacctgcctcccaggagccctcccctgccgcttctgccgaggctgatggcaagttaattcaggacaacagaagagaaactaaaaatgttgcatctgcaggtggtggaattggagatggtggtcgaattggagatggtggtcaggaaccgacaacaggcaactggagaggaatgctgaaaacttcaaaagctgaagaattacttgctgaagaaaaatcaaaaccaattccaattatgccagcaagtccacaaaaaggccatgctgtcaatttgctagatgtgccagttccagttgcacgaaaactgtctgcccgagaacagcgagattgtgaggttattgaaagactcatcaaatcatattttctaattgtcagaaagaatattcaagacagcgtcccaaaggcagtaatgcattttttggttaatcatgtgaaagatactcttcagagtgaattagtagggcagctgtataagtcatccttattagatgaccttctgactgaatccgaggacatggcacagcgaagaaaagaagcggctgacatgctgaaggcattacaaggagccagtcaaattattgctgaaatccgagagactcatctttggtgaacagaactgtttggtcttctacactttgctgacttgaacctactagctactgcctacctgagtagaagtttatttatggacttttgtgtatcgcagtgtatgaatttgcttgtgtgaagactggctataagctgaaaagtatattattcattacaagacaaatcacatgtttaattcacatttttcaagtttcctatgatgtatatcaagtctgtccgtttcagtcaaacttacaagaacaattgatgttctagttgtacaaagcagtttgcctgtgcatatgatgacccgcgtaacctttttttagtcttaaagctgcagccgtagtcctcaaagaggaagctccaggacatttcatgactataatgcatgcactatttatatagactgacctggcttcaaaaggtggagcctggcgagttcctcacataatcaatgtatccacctatccttcatttttatagtcttaaaaaacaaacaaaattctgtaacttctgcagttttaggaaaaatataagatctgaaagactcataaagatgtaggaacagactgtgtaattaatggctcctgagtctatactgccctaatgttagaaagtaaaatatgctttgattcaaaataagcctgaaaatataaattgacttcctgcattaaaaataactattaggaactttcttagtaacaataactggtcctgttagtttctaaatgactcagtgacaacctaaatttccctaatttacaagtacatcgattgcagtccagatgcaccttagggtggggcgctgactctggggctccgagactcagttatgtgagacctaaaagtctactctgtt

SEQ ID NO: 2416 - DNA, 1831 bp, Rattus norvegicus
  Genbank Accession No. NM_053656
gccgctgcacagccccggcttcccgcgggggcggccatggtccggcgcttggcccggggctgctggtccgcgttctgggactacgagacgcctaaggtgatcgtggtgcggaatcggcgcctgggattcgtgcaccgcatggtgcagcttctcatcctgctttacttcgtgtggtacgtcttcatcgtgcagaaaagctaccaggacagcgagaccggaccggagagctccatcatcaccaaagtcaaggggatcaccatgtcggaagacaaagtgtgggacgtggaggaatacgtaaagcccccggaggggggcagtgtagtcagcatcatcaccaggatcgaggttaccccttcccagaccttgggaacatgcccagagagcatgagggttcacagctctacctgccattcagacgacgactgtattgccggacagctggacatgcaaggcaatgggattcgcacagggcactgtgtaccctattaccatggggactccaagacctgcgaggtgtcagcctggtgcccggtggaggatggaacttctgacaaccattttctgggtaaaatggccccaaatttcaccatcctcatcaagaacagcatccactaccccaagttcaagttctcaaagggcaacattgcaagccagaagagtgactacctcaagcattgcacatttgatcaggactctgacccatactgtcccatcttcaggctgggtttcattgttgagaaggcaggagagaacttcacagaactggcacacaagggcggtgtcattggagtcatcatcaactggaactgtgacctggacttgtctgaatcagagtgcaaccccaaatattctttccggaggctcgaccccaagtatgaccctgcctcctcaggctacaacttcaggtttgccaagtattacaagataaacggcactaccaccactcgaactctcatcaaagcctatgggattcgaatcgatgttatcgtgcatggacaggcagggaaattcagtctcattcccaccatcatcaatctggccactgctctgacctccatcggggtgggctccttcctgtgtgactggattttgttaacgttcatgaacaaaaacaagctctacagccataagaagttcgacaaggtgcgtactccaaagcatccctcaagtagatggcctgtgacccttgcccttgtcttgggccagatccctcccccacctagtcactactcccaggatcagccacccagccctccatcaggtgaaggaccaactttgggagaaggggcagagctaccactggctgtccagtctcctcggccttgctccatctctgctctgactgagcaggtggtggacacacttggccagcatatgggacaaagacctcctgtccctgagccttcccaacaggactccacatccacggaccccaaaggtttggcccaactttgatctcatcctcactaaactacagacctggacctgggaaggcagagacagctttggctgctaaggcagtcctagagaagatctgcgctcttcagtaaccatgtccatgtgactgggaaacagaaacctgtgcaagaggacaggcgtcttgctttagcccaagcttacattcttcctctccctaaggcctctggggagaagtgggttccctgccatctcctttcccaacagaactcctcataggacctttccctgctcacctcttgtactctcatacagtattcagggaccccaagttaggggctatgctcctgttgtataatttcaagcccccctttagaagttgcagcatgctgagttcaataaaccagtgatgagc

SEQ ID NO: 2417 - DNA, 2092 bp, Rattus norvegicus
  Genbank Accession No. NM_053662
agtctcgctttgggttccggctgcgtcgggcgtgcgtgtagctcgctagaactatggcgtccgggcctcacccgacatcgaccgctgccgccgcctctgcctcgtccgccgccccgagtgcgggcggctccagctccggcacgacgaccacgacgacgacgacgaccggagggatcctgattggcgaccgcctgtactcggaggtgtcgcttaccatcgaccactcggtgattccggaggagcggctctcgcctaccccgtccatgcaggacggcctcgacctgcccagcgagacggacctgcgcatcttaggctgcgagctcatccaggccgccggcattctcctccggctgccgcaggtggcgatggctacggggcaggtgttgtttcatcgttttttctactccaagtctttcgtcaaacacagtttcgagattgttgccatggcctgtattaatcttgcatcaaaaattgaagaagcaccaagaagaataagagatgtgattaatgtattccaccacctccgccagttaagaggaaaaaggactccaagccccctgatccttgatcagaactacattaacaccaaaaatcaagttatcaaggcagagaggagggtgctaaaggagttgggattttgtgttcatgtcaagcatccccataagatcattgtaatgtatttacaagtcttagaatgtgaacgtaaccaaaccctggttcagactgcctggaattatatgaatgacagtcttcgaaccaatgtttttgttcgctttcaaccagagactatagcatgtgcttgtatctaccttgcagctagagcacttcaaattccattgccaactcggccccattggtttcttctttttggtaccacagaagaggagattcaagaaatctgcatagagacacttagactttataccaggaaaaagcctaactatgaattgctggaaaaggaagtagaaaaaagaaaagtagccttacaggaagccaagttaaaggcaaagggattgaatcttgatggaactccagccctttccactttaggtggtttttctccagcctccaaaccatcatcaccaagagaagtaaaagctgaagagaaatcaccagtttccattaatgtgaagacagtcaaaaaagaacctgaggatagacaacaagcttccaaaagcccttataatggtgtaagaaaagacagcaagagaagcagaaacagcagaagtgccagtagatcaaggtcaagaaccaggtcacgctctagatcacacaccccaagaagacattataataataggcgaagtcgatctggaacatacagctcaagatcaagaagcaggtctcgcagtcacagtgaaagtcctcgaagacatcataatcatggttctcctcaccttaaggccaaacataccagagaagatttaaaaagctcaaatagacatggtcataaaaggaaaaaatctcggtctcgatctcagagcaagactcgggatcactcagatgttaccaagaaacacaggcatgaaagggggcatcacagagacaggcgtgaaagatctcgctcctttgagaggtcccataaaggcaagcaccacggtggaagtcgctcaggacatggcaggcataggcgctgactttcatcctctgacactgcatcggtccctggtgttgcccatatgcagtgtgacgatgtatggactcaatcaaaacatgaaaagcaaactgattagggattgatttattaaaattgtctaggtttctagaaacactgaggacattttcttttgaaaagaactatgttaaggttttttgcacattaaaatgccctagcagtatctaattgaaaaccatggtcaggttcaattgtactttattatagttgtgtattgtttattgctataagaactggagcgtaaattctgtaaaaatgtatcttatttttatacagataaaacttgcagacactgttctatttaagtggttatttgtttaaatgatggtgaatactttcttaacactggtttgtccgcatgtgtaaagatttttacaaggaaataaaatacaaatcttgtttttctaaaaaaaaaaa

SEQ ID NO: 2418 - DNA, 2727 bp, Rattus norvegicus
  Genbank Accession No. NM_053682
  misc_feature (1)..(2727): n = a or c or g or t
tntggcgggaaaggtcccgagggnccngagatgttctccctgtcgagcactgtgcagcctcaggttacagttcctctcagtcatctcatcaatgccttccattcaccaaaaaatatatccgtttccgtcaatacatctgcttctccaaaacagcatcgagatacagttgctgagcatgaagctcccagtagtgagcctgtgcttaatttaagggaccttggattatctgaattgaaaattggacagattgataaactggtagaaaatttacttcctggattttataaagacaaaagagtttcttcctgttggcatacatctcatatctcggcacagtccttttttgaaaataaatatggtcacttagatatgttcagtacattacgttcctctagcttgtacaggcaacatccaaaaactcttcagagcatttgttcagatcttcagaattttccagttttcatacagtctcgtggtttcaaaactttgaagtcaaggacacggcgtttgcaatctacttctgaaagattagcagaagcacagaatatagcaccatcatttgtgaaggggtttcttttgcgggacagaggaacagatcttgagagtttggacaaacttatgaaaactaaaaacatacctgaagctcaccaagatgcatttaaaactggttttgcagagggttttctcaaagctcaagctcttacacagaagaccaatgattccttaaggcgaactcgtctgattctctttgttttgctcctgtttggcatttatggactcttaaaaaatccatttttatctgtgcgcttccggacaactacaggacttgattctgcagtagaccctgtccagatgaaaaatgtcacttttgaacatgttaaaggggtggaggaggccaaacaagaattacaggaagtggttgaattcttgaaaaacccacagaagtttactgtgcttggaggtaaacttcccaaaggaattctcttagtggggccaccaggaacagggaagacccttcttgcccgagctgtggcaggagaagctgatgttcctttttattatgcttctggatcagaattcgatgagatgtttgtgggtgtaggagccagcaggatcagaaatctttttagagaagcaaaagcaaatgctccttgtgttatattcattgatgaattggattctgttggtgggaagagaattgaatttccaatgcatccatattcaaggcagactatcattcaacttcttgccgaaatggatggtttcaaacctaatgaaggagtaatcattataggtgccacaaatttcccagaggcattagataatgccttaatacgtcctggtcgttttgatatgcaagttacagttccaaggccagatgtgaagggtcgtactgaaattttgaaatggtatcttaataaaataaagtttgataaatctgttgatccagaaatcatagctcgaggaactgttgggttttctggagcagagttggagaatcttgtgaaccaagctgcattaaaggcagcagttgatggaaaagaaatggttaccatgaaggaactagagttttccaaggataaaattctaatgggaccagaaagaagaagtgtggaaattgataacaaaaacaaaactataacagcctatcatgaatctggtcatgctattattgcatattacacaaaggatgcaatgccaatcaataaagctacaatcatgccacgagggcccacacttggacatgtatcactgttgcctgagaatgacagatggaatgaaattagagcccagctgcttgcacagatggatgttagtatgggaggaagagtggcagaggaactcatatttggaactgatcatattacaactggtgcttctagtgattttgataatgcaacaaaaattgcaaagaggatggttaccaaatttggaatgagtgaaaagcttggagttatgacctacagtgatacaggaaagctaagtcctgaaactcaatcggccattgaacaagaaataagaatccttctacgggaatcatatgaacgagcaaaacatatcctgaaaacacatgcgaaagaacataagaacctggccgaggcgttgctgacctatgagactttggatgccaaagagattcaaattgttcttgaggggaagaaattagaagtgagatgataactctgttgatattgctggttttattacaagaatatacttagtcctacagtctcctttgcaacacttccaacccccacttctgacttggtatctaattccaggatgtgaaacactttgtcagtcttctgttccattatttgattttggttattcctgtggtgatactcattggagattagtaacctataacaagtacacgaaaagataaataaagagctgtcaggattaaagtcaattgaaaaatgtcaatcatggtgaaagtaagcaatcattttgtggttgattactccaagtgagtaaaaattgtgcctttatgtactggtaagtatggttttttttttctttgcaagctaamtttgaaaatctatcatctcctgatggtaacatttctctttggggaaacaaatgccatggataaaccatttctacttatatcagtagagatgccattaagatgtacttaattttgttcttgattgaccatgtaaaatggcctttammagmmsskryykkmrktgtaaanntaaataccagcccgggccgtcg

SEQ ID NO: 2419 - DNA, 1155 bp, Rattus norvegicus
  Genbank Accession No. NM_053698
cacgagggttggcagctgcctggcggtcctgaggagcggctagggcagcggagggaaagaaaagggaacggctcggaatttgctccagcggctgctgcaagacctcggcgccaacctcgcaccagcgagcgccccacagcccttcggctgcccctctatgtgctgctgagccggtcctggacccgacgagcccgccttcggtgttccgagccgaaatcgcaaagacggaaggactggaaatggcagaccatatgatggccatgaaccacggtcgcttccccgacggcaccaacgggctgcaccaccaccctgcccaccgcatgggcatggggcagttcccgagcccgcatcaccaccagcagcagcagccccagcacgccttcaacgccctcatgggcgagcacatacactacggcgcgggcaacatgaatgccacgagcggcatcaggcacgccatggggccggggactgtgaacggggggcaccccccgagcgctctggccccggccgccaggtttaacaactcccagttcatgggtccccctgtggccagccagggaggctccctgccggccagcatgcagctgcagaagctcaacaaccagtatttcaaccatcacccctacccccacaaccactacatgccggatttgcaccccgctgcaggccaccagatgaacgggacaaaccagcacttccgagattgcaaccccaagcacagtggaggcagcagcacccctggcggcgcgggtggcagcggcacccccggcggctccggcggcacctcgggcggcgcgggtggcagcagcgcgggcggcagtggcggtggcagcaccatgcccgcctcggtggctcacgtccccgcggcaatgctgccgcccaatgtcatagacactgatttcatcgacgaggaagtgcttatgtccttagtgatagagatgggtttggaccgcatcaaggagctgccagaactctggctgggccaaaatgagtttgattttatgacggacttcgtgtgcaaacagcagcccagcagagtcagctgttgactcggttaacctcgcggctgaaagaaatcaccctccctgcccccacccccaacttcttcggtgtgaattaaaaaaaatcaaaaacaaacaaaaaaaaaacaaaaaa

SEQ ID NO: 2420 - DNA, 1690 bp, Rattus norvegicus
  Genbank Accession No. NM_053703
tgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccccggccttaagattccaagggaagcgtttgaacaacctcagaccagttccacgccgcctcgggatttagactccaaggcttgcatttctattggaaaccagaactttgaggtgaaggccgatgacttggagcctatagtggagctgggacgaggtgcgtacggggtggtggagaagatgcgtcacgtgcccagcgggcagatcatggcggtgaagcggatacgggccacagttaatagccaggagcagaaacggctactgatggatctggatgtttctatgaggacagtggactgtccgtttaccgtgaccttctatggtgcactcttccgggagggcgatgtgtggatctgcatggagctcatggatacgtcactagataaattctacaaacaagttattgataaaggccaaacaattccagaagatatcttagggaagatagcagtttctattgtaaaagcattagaacatttacacagtaagctctctgttatccatcgagatgtcaagccttcaaatgtgctcattaacacgctgggccaagtgaagatgtgtgactttggaatcagcggctacctggtagactctgttgcgaaaacgatcgatgccggttgcaaaccatacatggctcctgaacgaataaatccagagctcaaccagaaggggtacagtgtgaagtctgacatttggagtctgggcatcaccatgattgagctggccatcctccggtttccctatgattcttggggaacgcccttccagcagctaaaacaggtggtagaagagccgtctccacaactcccagcggacaagttctctgctgacttcgttgactttacctcacagtgcttgaagaaaaattccaaagaacggcccacgtatccagagcttatgcaacatccatttttcaccgtccatgaagccaaagcagcagatgtggcgtctttcgtaaaactgatactcggggactaaaaagccacggacttgactggttgaccctactgtggattggtgggtttacagggcgaagtgagttcaccacagcgccaacagaaagtcatcttgagatcattgaaccctgcctctctgaggggcttcctctccctgtttttctttttcctctccgaagggggccttggaatctctagcgtaggctgagctctctatatggatgaaatatgatagaggcttaggactcgaaaaggtgataaaatatttaatggcgaggcatacgaggagtcctcaagcctctgggatctctcgtgttctttacaaaatgaatgcattggccctggtaacaaggtgctacagtagttgacgagattgtaaagtaggttcgtagcgtatcccacttattttaatatttatgtttcagtgcttggttggaaatattccatttttatgcaagaagggagatacagagacaaggctgacttggcagtgtttatagggcttttattttttaagttcaatcatgtctgtggtccagaggaagttatttaatatgcatctttaagaatattataaaaaaaaaatctcaagcaaagggg

SEQ ID NO: 2421 - DNA, 2393 bp, Rattus norvegicus
  Genbank Accession No. NM_053713
atcttcgttgacttcggggtttgggtacccctctctcttcttcggactccggaggaccttctgggcccccacattaatgaggcagccacctggcgagtctgacatggctgtcagcgacgctctgctcccgtccttctccacgttcgcgtccggcccggcgggaagggagaagacactgcgtccagcaggtgccccgactaaccgttggcgagaggaactctctcacatgaagcgacttcccccacttcccggccgcccctacgacctggcggcgacggtggccacagacctggaaagtggtggagctggtgcagcttgcagcagtaacaacccggccctaccccggagggagaccgaggagttcaacgatctcctggacctagactttatcctttccaactcgctatcccaccaggaatcggtggccgccaccgtgaccacctcggcgtcagcttcatcctcgtcttccccagctagcagcggccctgccagcgcgccctccacctgcagcttcagctatccgatccgggccgggggtgacccgggcgtggctgcgggcaacacaggtggagggctcctctacagccgagaatctgcgccacctcccacggcccccttcaacctggcggacatcaatgacgtgagcccctcgggcggcttcgtggctgagctcctgcggccggagttggacccagtatacattccgccacagcagcctcagccgccaggtggcgggctgatgggcaagtttgtgctgaaggcgtctctgagcacccctggcagcgagtacaccagcccttcggtcatcagtgttagcaaaggaagcccagacggcagccaccctgtggtagtggcgccctacagcggtggcccgccgcgtatgtgccccaagattaagcaagaggccgtcccgtcctgcacggtcagccggtccctagaggcccacttgagcgctggaccccagctcagcaacggccacaggcccaacacacacgacttccccctggggcggcagctccccaccaggactacccctacactgagtcccgaggaactgctgaacagcagggactgtcaccctggcctgcctcttcccccaggattccatccccatccggggcccagctaccctcctttcctgccagaccagatgcagtcgcaagtcccctctctccattatcaagagctcatgccaccgggatcctgcctgccagaggagcccaagccaaagaggggaagaaggtcttggccccggaaaagaacagccacccacacttgtgactatgcaggctgtggcaaaacctatacgaagagttctcatctcaaggcacacctgcgaactcacacaggcgagaaaccttaccactgtgactgggacggctgtgggtggaaattcgcccgctcagatgaactgaccaggcactaccgcaaacacaccgggcaccggccctttcagtgccagaagtgcgacagggccttttccaggtcggaccaccttgccttacacatgaagaggcacttttaaattccacatcgtggacatgacccacactgccaggagagagttcagtatttttttttaacctttcacactgtcttcccacgaggggaggagcccagctggcaagcgctacaatcatggtcaagttcccagcaagtcagcttgtgaatggataatcaggagaaaggaagagtccaagggacaaaagaaaagaaaagaaaaaaatactaaaaaacaaacaaacaaaaaaaaaaaacaaaagaaaaaaatcacagaacagatggggtctgagactggatcttctatcattccaataccaaatccgacttgaacaagactggacttacaaaatgccaaggggtgactggaagtttgtggatatcagggtatacattaaatcagtgacctggggggagggaagaccagagttcccttgaattgtgcttcaatgatgcaatatacatggaaagaccaccttgtatgctctttgccttctaaaaagccattatgacgtcagaggaagaggaagcaattcaggtacagaacgtgttctaatagcctaaacgatggtgcttggtgagtcgtggttctaaaggtaccaaacgggggagccaaagttctccaactgctgcatactttgacaaggaaaatctatttttgtcttccgatctacatttatgacctaagtcaggtaaataagcctggtttatttctgtaacattttttatgcagacagtctgttatgcactgtggtttcagatgtgcaataatttgtacaatggtttattcccaagtatgcctttaagcagaacaaatgtgtttttctatatagttccttgccttaataaatatgtaatataaatttaaaaaaaaaaaaaaaaaaaaaaaaaaa

SEQ ID NO: 2422 - DNA, 1908 bp, Rattus norvegicus
  Genbank Accession No. NM_053739
atggaggggtctaaggcgtccagcagcaccatgcaggtgagcttcgtgtgccagcgctgtagccagcctctgaaactggacacgagcttcaagatcctggaccgagtgaccattcaggaactcacagctccattacttaccacagcccaggcgaaaccaggagagagccaggaggaagaggctaactcaggagaggagccatttattgaaactcgccaggatggtgtctctcgaagattcatccccccagccaggatgatgtctacagaaagtgctaatagcttcactctgatcggggaggcatctgatggtggcaccatggagaacctcagccggagactcaaggtcactggagacctttttgacatcatgtctggccagacagatgtggatcacccactgtgtgaggaatgcacagatactcttttagaccagctggacactcagctcaatgttactgaaaacgagtgtcagaactacaaacgctgtttggagatgttggagcaaatgaatgagggcgacagtgaacagctacagagggagctgaaggagttggccttggaggaggagaggctgatccaggagctggaagatgtggaaaaaaaccgaaaggtggtggcagaaaacctggagaaggtccaggctgaggcggagagactggaccaggaggaagctcagtaccagcgagaatatagtgaatttaaaaggcagcagctggagctggatgatgagctcaagagtgtagagaaccagatgcgctatgcccagatgcagctggacaagctcaagaaaaccaatgtcttcaatgcgaccttccatatctggcacagcggacaatttggcacgatcaataatttcagactgggtcgcttgcccagtgctcctgtggaatggaatgaaatcaatgctgcctggggccagacagtgttgttgctccatgctttggccaataagatgggtctgaaatttcagaggtaccgacttgttccctatggaaatcactcgtatctggagtccctgacagacaaatctaaggagttgccgttgtactgttctgggggtttgcggtttttctgggacaacaagtttgaccatgcaatggtagcttttctggactgtgtgcagcagttcaaagaagaggtggaaaaaggagagactcgattttgtcttccgtacaggatggacgtggagaaaggcaagattgaagacactggaggcagtggcggctcctattccatcaaaacccagtttaactctgaggagcagtggacaaaggcgctcaagttcatgctgacgaatctcaagtggggtcttgcttgggtgtcctcacagttctataacaagtgacttgctccttaggggatatttgcctttaaggttttacattttgtttggtttggaaagatgctttaaattaaatttgggtaatattaaaccacatgtttacaataccagaatccacaaaagctactttattttacaatatgacagttttcagagcacagcacgccatgtatagcaaagagccctgccgtagtttggctcaaccccatgctgtcctttccctcttccctggaaacaactaatttaaatttgctttgttttcttttttaagttgaattgacattaatgtgttttcactggattttatctctctcaacttcctgtacttaaaatttgaaacagaaaagttttgagatgagatgcttgtggcacacagttgggtaatgtggggaaaggacaagaggtacaggtttaactctgtcctcacttctagtattgaacgcttactgtgctaactattggaattacaaaatgctgtttgatactgtttgagatgtggaaggatttaattatttgtaataaaggatttgctatggtctattaattaccaaaaaaaaaaagctt

SEQ ID NO: 2423 - DNA, 2680 bp, Rattus norvegicus
  Genbank Accession No. NM_053742
gcagctgtgagggcttcccggaagatggtgctgattaaggaattccgtgtagttttgccgtgttctgttcaagagtatcaggttggacagctttactctgttgcagaagcgagtaagaatgaaactggtggtggagaaggaatcgaagtcttgaagaatgaaccttatgaaaatgatggcgagaagggacagtacacacacaaaatctaccacctgaagagcaaagtccctgcgttcgtgaggatgattgctcccgagggctccttggtgttccatgagaaagcctggaatgcttacccctactgcagaacaattgtaacgaatgagtacatgaaagatgacttcttcatcaaaatcgaaacatggcacaaacctgacttgggaacattagaaaatgttcacggtttagatccaaacacgtggaaaaccgttgaaattgtccacatagacattgcagatcgaagtcaggttgaaccagcagactacaaagctgatgaggaccctgcgttattccagtcagtcaagaccaagagaggccccctgggacctaactggaagaaggagctggcaaacacccctgactgtcctaagatgtgtgcctataagctggtgaccatcaagttcaagtggtgggggctgcagagcaaagtagagaacttcatccagaagcaagaaaaacggatatttacaaacttacatcgccagctcttttgttggattgacaagtggattgacctgacaatggaagacattaggagaatggaggacgagactcagaaagaactagaaacaatgcgtaagaagggttccgtccgaggcacgtcggctgctgatgcctagatgagcccctgtaggtcagagacattatcaaactgtctacggagtcaaggccaagtgagggggaccagtgcggcctgcgacgactaaagccaccagcgtctcagtgttgacggatgtttccagtgtgtgcctctgacggctcgggcacacttgtgcacactcgagggcacacacacacccatgcacacacactcacactgtatgtatgtctgtagctgtatgtaaagcacatatggctacaggcctagatacacacgagtgtatatatatatgtacatgtgaagatggatcagtaccttttctccaaagtactgcacctgtcttcagcagaaatactaaagaaaatattttcaatatatatacctggaacagatattaatacccatcaacatgatgccctggatggacaaacggactgccatgtggtgccctgtggtgctggctggcgtgcttcgtgaatgccaggtgtggaccagtgtgtacagcctttggttaggtttctgtttttttcaagtcaccacacacacacacacgtttagtctcaacccatcagcaacaactcctacagaaagattttttcaaatttttagatactccagtgactctggaatgtaaactctggatgtatttataactatttatttctgggtggccactatcttccagccaaatccaacaatatctgtcaagtaaggagtgaaagctctttattggtttgcccgagggttggggatatccttttttttaaaaaattgccactttttattggatttttgtattttgaatttcaagtatttttctatatcaaatctagcaaaaaacggtgatgacggtttgtgatttataataaacactgacaatattcagattctggctaagcaaacagggtgatcaggcaattaacctgagtggcactggaggctgtgcagagccattctgtggagttttgtttctgaaatggcttttctggaattacggcctggagactggatggtctgtattgctctcagttcacagggtaggagagtggtcccgcccggctgtttccagttacagtccaagctaggaggaaatgctgatgggagcaggcacagcttgagcatgacacaggcctgtccccgtcctgaggcccagctagacctgggccttgccgacagctctgcttcctcctcctgtatctcctcctcctcccccttcctcttctgtctctactttctcctttttttttaagagaaaggagcagtagctgggaaggattttcttttttttacctttccgtctgatgctattctcctctcgtcagtcctggaaccctgaccagcatcacactgttgaatccttcaggttacacactgccttttaacctccaccctgcagtcagagcacggtggtgacacccctttgttgacaggcttgaccttcatgtcccttctgccctgccctgtgtcccatgggggaaatggcagagagtcccactgcatcacactgccctgttagcctcagcaacaagccctgggttccatgtcctctaagctctagataaaggtggttattccctgggcactgctggaagctgggaaggtcaccaccagaagggtcattgccagccttgtctcctccagtgaaaccagatcacagacatccatagtttctctgagagctggggcacacaaggaaaccagagcccagtatggattcttgtgttgctctagcagctgtggagattgagggatgtggtgaatgcaaagaacccagtttacttggcagtctcctgtgtaaatcacagtaaaacaaagtgaaatcgaaacaagaataaatttgatctcaaaatgaaaaaaaa

SEQ ID NO: 2424 - DNA, 1604 bp, Rattus norvegicus
  Genbank Accession No. NM_053743
cgagcggactctctagcccttgtgggtccctgttcagcgcccggccgtgtggagacccgggagccagtccgggcctccgaggcgaagatggtggactacagcgtttgggatcacatcgaggtgtcggacgatgaggacgagacgcaccccaacatagacacggccagcctgttccgctggcggcaccaggcccgggtggaacgcatggaacagtttcagaaggagaaagaagaactggaccggggctgccgggaatgcaagcgcaaggtagccgagttccagcgcaagctgaaggaactggaagtggctgagggtggtggccaggtggagcttgagcggcttcgagcggaggcacagcagctgcgcaaggaggagcgaactgggagcagaagctggaggacatgcggcaaaaaggagaagaacatgccctggaatgtggacacactcagcaaagatggcttcagcaagagcatggtcaataccaagcctgagaaggcagaggaagactcagaggaggcaagggagcagaaacacaagaccttcgttgaaaaatacgagaaacagatcaaacatttcggcatgctccaccgctgggatgacagccagaagtacctgtcagacaatgtccacctggtgtgcgaggagacagccaactacctggttatctggtgcattgacctggaagtcgaggagaagtgtgccctgatggagcaggtggctcaccagaccatggtcatgcagttcatcctggagttggccaagagtctgaaggtcgacccccgggcctgcttccggcagtttttcaccaagatcaagactgctgaccagcagtacatggagggcttcaagtatgaactggaggcctttaaggagcgtgtgcggggccgcgccaagctgcgaatagagaaggccatgaaggagtacgaggaggaggagcgcaagaagaggctaggccctggtggcctggaccctgtggaggtctacgaatctctgcctgaggagctgcagaagtgctttgatgtgaaggatgtacagatgctgcaagacgccatcagcaagatggatcctactgatgccaagtatcacatgcagcgttgcatcgattctggcctctgggtccccaactccaagtctggtgaggccaaggagggggaggaggcgggccccggggacccattgctggaagccgtccccaaagcgggcttcgagaaagacatcagtgcgtgacccttctccagaaaaggaaacccagccaccatgtccctagctcccgacttcttcacttctgctgctcctcacgtcctggcccatggcctgccccatgtcccctctcctccggcctgtccccagcactcatcagattctctgcttcgggttgaggggctctgctgtctgcagcccccccacccccatcagcgttatgccaaagtcctgggggtctggggaggggcagcagctgccaggttggtccaccgggttggggatacacatgtccccatctgggcagggtctgtccctatgggtctatggtcactgtttctcttctgtctagctttctgtcctgcaactggcaacaatgtccaataaacagttccaggtgctgg

SEQ ID NO: 2425 - DNA, 1684 bp, Rattus norvegicus
  Genbank Accession No. NM_053752
gctcctactgggcctgactttgctggtgagctccctgcaagctttggtgtgctttgagtgtggcaacctcaattctatggggatttgtaactttagaacagctgtatgttacgctcatcctggtgaggtttgtgcctcagttttaacctataaagatggaaaatttgtatatggaaaccagagctgtgctgagtgctccgggaggactgttgagcatggaagtctgatagtatcaacaaactgttgctcagccacctctttctgcaatatagtacgtccctgatacttaattgtatggaaggattttagtgctctttactgagtcttgacactggagcatgccagaaagaattatctactgaccgtgtctggagaacgcactaagatttctacatcatgttttctgactacgtgtacatcatatcatatgatcttcagtgatctgtaataaattgaaggccttacaaattttgcggctgccactgcaaccatggtctccggcagcagcggccttgccgccgcccgcctgctgtcgcgcaccttcctcctgcaacagaatggaatacggcacgggtcttacacagcctctcggaaaaatatctatattgataaaaatacgaaggttatttgccagggtttcacaggcaagcagggtacctttcacagccagcaggctttggagtacggcaccaaactcgtgggaggaaccactccagggaaagggggcaagaagcacctgggcttacctgtctttaatactgtgaaggaagccaaagagaaaacaggagcgacagcttctgtcatttatgtccctcctcctttcgctgctgccgccatcaatgaagcaattgacgcagagattcccttggttgtgtgcattactgaaggtattccgcagcaggacatgttgcgggtcaagcacaagctgacacgccaggggaagacgaggctaattgggccaaactgccccggtatcatcaaccctggagaatgcaaaatcggcatcatgcctggccacattcacaagaaaggaagaataggtatcgtgtccaggtccggtactctgacttatgaagcagttcaccaaacaacccaagttggattggggcagtccttgtgtattggcattggaggtgacccttttaatgggactaattttattgattgccttgacgtcttcctgaaggatccagctacagaaggcatcgtactgattggtgaaattggtggtcacgctgaagaaaatgccgcggagtttctgaaggagcataactcaggtccaaaggccaagcctgtagtgtccttcattgctggtataactgctcctcctggcagaaggatgggccacgcaggggcgattattgctggaggaaaaggtggcgccaaagagaagatctctgctcttcagagtgcgggtgtaattgtcagcatgtcccccgcacagctgggaacctgcatgtataaggaatttgaaaagaggaagatgctttgaaggacacgacatgaattttaaggctgtggaggaaatctcacagactggagagcccgtccagactgcagcccaggcacctgaccctggtctctcagtacaggggaagtccaggcatgttttagaatgtcctaaattgagctattttcacttactgtgtaacagagacagataataaatctatcatttgatttg

SEQ ID NO: 2426 - DNA, 2508 bp, Rattus norvegicus
  Genbank Accession No. NM_053765
ctgaggaactctattttaaaaaactctcaagtaaaaaaaagcaagtcatggagaagaacgggaataaccggaagcttcgggtttgcgttgccacctgcaaccgagccgattactccaaactggcccccatcatgttcggcattaagacggagcctgcgttcttcgagctcgacgtggtggtgctgggctctcacctgatcgacgactacggaaacacataccgcatgattgagcaggacgactttgacatcaacaccaggctacacacgattgttagaggggaagacgaagcagccatggtagagtcagtgggcctagcgctagtgaagctaccggatgtcctcaaccgcctgaagcctgacatcatgattgttcacggagaccgatttgacgccctcgctctggctacatctgctgccctgatgaacatccgcatccttcacattgaaggaggagaggtcagcgggactattgatgactctatcagacacgccataacaaaactggctcactaccacgtgtgctgcaccaggagtgcagagcaacacctgatctccatgtgtgaggaccacgaccgcatccttttggctggctgcccttcctatgacaaactgctctcagccaagaataaagactatatgagcatcattcggatgtggctaggtgatgatgtaaaatgtaaagattacattgttgccctgcaacacccggtgaccaccgacattaagcattccataaagatgttcgaactgacactggatgctcttatctcatttaacaagaggaccctagttctgtttccaaatatcgatgcaggcagcaaggagatggttcgagtgatgcggaagaagggcatcgagcatcaccccaatttccgcgcagtcaagcacgtcccgtttgaccagttcattcagctggtcgcccacgctggctgcatgattgggaatagcagctgtggagtgcgtgaggttggcgcctttggaacccctgtgatcaacctgggcacgcggcagataggaagagaaacgggggagaatgttcttcatgtccgggatgctgacacccaagacaaaatattacaagcactacacctccagttcggtaaacagtacccttgctcaaagatatatggggatggaaatgctgttccaaggattttaaagtttctcaaatccatcgaccttcaagagccactacagaagaaattctgcttccctcccgtgaaggagaacatctctcaggatattgaccatatcctcgaaactctgagtgccttggctgttgatctcggggggacgaatctgagagtggcgatagttagcatgaagggtgaaatagttaagaagtacacccagttcaatcctaaaacctatgaggaaaggattagtctaatcctgcagatgtgtgtggaagcggcagcagaagccgtgaagctcaattgcagaattctgggagtaggcatctccacaggtggccgtgtgaatccccaggaaggagttgtgctgcactcgaccaagctgatacaggagtggaactctgtggacctcaggacaccactctccgacaccctgcatctccccgtgtgggtggacaacgacggcaactgcgctgccatggcggagaggaagtttggccaaggaaaaggacaggagaactttgtgacgctcatcacagggacagggatcggtgggggaatcatccaccagcacgagctgatccacggcagctccttctgtgcggcagagcttggccacctcgtggtgtctctggatggtcctgactgctcctgtggaagccatgggtgcattgaagcctacgcctctggaatggccttgcagagggaagcaaagaagctccacgacgaggacctgctcttggtggaagggatgtcagtgccaaaagacgaagctgtgggcgccctccatctcatccaagccgccaagctgggcaacgtgaaggcccagagcatcttacggacagctggaactgctttgggactcggagttgtgaatatcctccacactatgaatccttccctggtgatcctgtctggagtcctggctagtcactacatccacattgtgagggacgtcatccgccagcaagccctgtcctccgtgcaggatgtggatgtagtggtttcagacttggttgacccggccctgcttggtgcggccagcatggttctggactacacgacccgcaggatccactaggcctcctgggaatagacctggactgagacccaagagctactgagtggaaccacgctctcttagatcagtatttcttcaaaggccagtgtgggaggctgcggagccagctcagtggtcaagagcctaaactgctcttgccaaagacccaagttcagttcccagcacccatgtcaggcactcaactgcctgaaagccaagctccaggggatccagtgcctcagctgcctcaggcagctgcactcaaatgtacatagtcctctccagaatacacgtaaattaaaataaatcttgg

SEQ ID NO: 2427 - DNA, 1908 bp, Rattus norvegicus
  Genbank Accession No. NM_053769
gcgcggtgaagccagattaggatcagcgagcacttgaggatttagggccacaaaaaaccgcacaagatcgacagactatttctggagagctgcagaacgggcacgctggggtcgctggtgctggccatggtgatggaggtgggcatcctggacgccggggggctgcgcgcgctgctgcgagagcgcgccgctcagtgcctgcttctggattgtcgctccttcttcgccttcaacgccggccacatcgtgggctcagtgaacgtgcgcttcagcaccatcgtgcggcgccgcgccaagggcgccatgggcctggagcatatcgtgccgaacaccgaactgcgcggccgcctgctggccggagcctatacgcccgtagtgctgctggacgaacgcagcgccgccctggacggccgcaagcgcgacggcaccctggccctggccgcgggcgcgctctgccgagaagcgcgctccactcaagtcttcttcctccaaggaggatatgaagcgttttcggcttcctgccctgagctgtgcagcaaacagtccacccccatggggctcagcctcccgctgagtactagtgtgcctgacagtgcagaatccggatgcagctcctgtagcacccctctctacgaccaggggggcccagtggagatcctgtccttcctgtacctgggcagtgcttaccatgcttcccggaaagatatgctcgacgccttgggtatcactgctttgatcaacgtctcggccaattgtcctaaccactttgagggtcactaccagtacaagagcatccctgtggaggacaaccacaaggcagacattagctcctggttcaacgaggcgattgactttatagactccatcaaggatgctggaggaagggtgtttgtgcactgccaggccggcatctccaggtcagccaccatctgccttgcttacctcatgaggactaaccgagtgaagctggacgaggcctttgagttcgtgaagcagaggcggagtattatctcccccaacttcagcttcatgggccagctgctgcaatttgagtcccaagtactggcccctcactgttctgcagaagctgggagcccggccatggctgtccttgaccggggcacctctactacaacggtcttcaacttccctgtctccatccctgttcaccccacgaacagtgccctgaactaccttcaaagccccatcacaacctctccgagctgctgaagggccaggggaggtgtggagtttcacgtgccaccgggacgacactcctcccatgggaggagcaatgcaataactctgggagaggctcatgtgagctggtccttatttatttaacacccccccccccaaacacctcccgagttccactgagttcccaagcagtcataacaatgacttgaccgcaagacatttgctgaactcagcccgttcgggaccaatatattgtgggtacatcgagcccctctgacaaaacagggcagaagggaaaggactctgtttgagccagtttcttcccttgcctgttttttctagaaacttcgtgcttgacatacctaccagtattaaccattcccgatgacatacacgtttgagagttttaccttatttatttttgtgtgggtgggtggtctgccctcacaaatgtcattgtctactcatagaagaacgaaatacctcactttttgtgtttgcgtactgtactatcttgtaaatagacccagagcaggctttcagcactgatggacgaagccagtgttggtttgtttgtagcttttagctatcaacagttgtagtttgtttatttatgatctgaagtaatatatttcttcttctgtgaagacattttgttactgggatgactttttttatacaacagaataaattatgacgtttctattg

SEQ ID NO: 2428 - DNA, 6331 bp, Rattus norvegicus
  Genbank Accession No. NM_053770
  misc_feature (1)..(6331): n = a or c or g or t
gaattcggcacgaggaaaaatctttggagagaagagagccacagtgagcacgctagtgcacaattattgcagccacgtgtgcccgcaagctggccctgcgacaagctgttgagtgctgttgcaattagctgattggagaacggggactgcagggtgataatgctgcgtctccgctcgcgggcaccaggaaagggttttgtctcgggaaggcaagtcttccctgcacagttatctcagcagctccctagctgaagagaactgggggctctaaagggagggggtcgcactgtgcgagcacagattctgtgccaggctgttgcttatgaaccgcacgtctgggaaagcaggtgtgtgctcggacgggcactgggctggaacgcaggcggcggctctcgggttcacctgcttcctgttaacagactgttggctcacagagcatctgctcttacacgctgaaactgcggctgagaaagggttcccggcatcccacttgactgacggaggcacttggattggacttaatcttaaacctctggaggtcaagaccttttaaaaagggctaaataaacaatctacatgttaaaggccagcgactcctacttcctctgttggagcaactgtgaagtccagcctcttctaggaaaactgaagactttaataacacaccgttcaaggtgaaaatgaatacagatagcggtgggtgtgctcgcaaacgtgccgccatgtctgtcacgttaacatctgtgaagagagttcaaagttctccaaacctattggctgcagggcgtgagtctcactctccggactcagcttggagatcttacaatggtcgaaatccagagacactgaacggagatgccacatattcctctcttgcagcaaaaggttttagaagcgttcgaccaaacctgcaagacaaaaagtcaccaacccagagccatatcactatcaacggcaactctggtggcgccgtgagtccagtgagttactatcagaggccattctccccttctgcatactccctcccagcctcactcaactccagcattatcatgccacacggcaggtcgcttgattctgcggagacatattcccagcatgcccagtcgctagacggcaccatgggaagctccatcccactctacagatcctccgaggaagagaagagggtcacagtcatcaaagccccgcattacccagggatcggccctgtggatgagtctggaatccccacagccattagaacgacagttgaccggccgaaggactggtacaagacaatgtttaaacaaattcacatggtacacaagccggatgaggacacagacatgtataatactccttacacatacaatgcaggtctgtacaactcgccctacagtgctcagtcacatcctgctgcaaagacccagacctacagacctctttccaaaagccactcggacaatggcaccgatgcttttaaggaggcaccctcaccagtgcctcccccacacgttccaccacgaccaagagatcagtcttcaacagaaaagcatgactgggatcccccagacagaaaggtggacaccaggaaatttcgatcggagccaaggagtatttttgaatacgagcctgggaagtcatccatcctgcagcacgaaagacccgtctccgtctaccagtcttccatagacagaagcttggaaagacccagcagctctgcaagcatggcgggtgactttagaaaacggaggaagagtgaacctgcagtgggcccgcccaggggcttgggggatcacagttcaagcaggaccagccccggccgggcagacctcccaggatcaagttccacctttaccacgtctttcattagttcttctccttcctctccctcgagagcacaaggtggggatgatagcaaaatgtgtccgcccctttgcagttactcggggctcaatggctcgccctctagtgagttagagtgctgcggcgcttatagaaggcacttggacgtcccccaggactctcaaagggccatcactttcaagaacggctggcaaatggcccggcaaaatgcagagatctggagtagcactgaagaggcggtttcccccaaaatcaaatcacgaagctgtgacgatctcctgaatgatgactgcggcagcttcccagaccctaaaaccaagtcagaaagcatgggttctctgttatgtgacgaaggctccaaagagagcgaccccatgacgtggacttccccctacatcccggaagtgtgcgggaacagcagatctaggctcaaacataggtcagcccataacgccccaggcttcctcaaaatgtacaagaaaatgcaccgcatcaaccgcaaggatttgatgaactcggaggtcatttgctctgtgaaatccaggatccttcagtacgagaaggaacagcagcacagggggctgctccatggatggagccagtcgtccaccgaggaggtgcccagggacgtggtacccactcgcatctcggagtttgagaagctgattcagaagtcaaagtctatgcccaatctaggagatgaaatgttatctcctgtaaccctagaacccccacaaaatggtttgtgccccaagaggcgattttctattgagtctctgctggaggaggaaactcaggtccgacacccttctcagggtcagcgaagctgcaagtcgaacaccctggtacccatccacatcgaggtcaccagcgatgagcaacctagaacacatatggagttttccgacagtgaccaagatggggttgtgtctgaccacagcgataacgtccacgtcgaaaggtcgtccttttgtagtgaaagtgacttcgaccacttttcattcacatcctctgaaagtttctacggatccagccatcaccaccaccatcaccaccaccatcacggacacttcatcagttcctgcaaaggccgatgccccgcttcttacactcgatttaccacgatgttaaaacacgaaagagctaagcatgaaaatattgaccgacccagaaggcaagacatggatcctggcctatctaaactcgcgtttctagtcagccctgtgcctttccgaaggaaaaaagttttgactccccaaaaacaaactgagcaggcaaaatgcaaagcctcggtagttgaggctctggactctgcccttaaagacatttgcgaccaaataaaagctgaaaagcggagaggaagcttgccggacaacagcatcctgcacaggcttattagtgaactgctgccacagattcctaagaggaattcatctcttaatgctctaaaaaggagccccatgcaccagcctttccacccactgcctcaagatggtgctattcattgtcccctgtaccaaaatgattgtgggagaatgcctcacagtgcctctttcccagacgtggacacgaccagcagctaccacgcacaggactatggtagtgtgctgagtctccaagatcacgagtcccctagaagttactcgtctactctgactgacttgggaagaagtgtatcacgggaacgaagaggaactccagaaaaagaggtaaaattgcctgcaaaagctgtctatgatttcaaagctcagacttctaaggagctgtcatttaagaaaggagacaccgtctacatcctcaggaaaattgaccagaactggtatgagggggagcaccacggaagagtgggcattttcccaatctcatacgtagagaaactaacacccccagaaaaagcgcagcccgcgagaccaccacccccagtccagccgggagagattggagaagccatagccaagtacaacttcaatgcagacacaaatgtggaactctccctgagaaagggtgacaggattattcttctcaaaagagttgatcaaaactggtatgaaggtaaaatcccaggaaccaacagacaaggcatcttccctgtctcctacgtagaagttgtcaagaggaacacgaaaggttctgaggattaccccgaccctcctctaccccacagctactccagtgatagaatttacagcctaagctccaataagccacagcgtcctgtgttctctcacgaaaacattcaaggtggaggagaaccgtttcaggctctgtataactatactcctaggaatgaagatgagctggaactcagagaaagtgatgtcgtagatgtcatggaaaagtgtgatgacggatggttcgtgggaacttcaagaagaaccaaattctttggtacttttcctggaaactatgtcaaaaggctgtgactcacctcactcctaatttatgccacatttcagccacacatctgcattaacccacctgaaacgtcccaggaggcctgttgctgcctcgccttatggtttcccaatagcccattaccatctccatctgctgccaccaaatcaccagcagagggactgccgctgtgagccttagggaggctgggagccttagagaaaagtggcaaaacttacacccacataaatattcagtctcctgctttctgccctgaactttgaaatgcctgtatatggaatcagaatgaaaatgatcatactttcaaaaaagtgaaataattaaggaagaaagaaagagaaaagaaatagagagactcttcaggaggctgtctggcctcatggctgaatctccacctctctggaaggtgtactgtcctcaggaagcctgaagattgttttttttctgaaatgctatggttccagttctcactctcatctaggcggtatattttcctttcacgagtttgcctagcgctcgggtttacactacatgacaactatacttcggctgttgtttgcttgcacttattattccttgtttcatgcacagtgatcacaaaatccagagtgcctagggaaggttcactggttccactggttcgagtgtgatttttgttgactgcattatattttcacacggggaggggggtctttcccctgcccacttttttgtgcttattagaagtgcaaacagtgagcaactgagagctcagccacaccacaggacaaatccgtgttgtgaattcgcattgctgttttgtgtattaaggtgtaatcatcagcttcatggacaacaagctattagtgatttctttacctgttaaaacttacaggcagtgctagtgagttaggcagaaagntgacagtaataccagtaggtgagcttcactgcgtgcatgctcacacgtttgagnttgtatgaggacatataattcatatgctatgttgtacattttatggaaatataagagaatcccacattattttatagagtacttcaggagcatcctaagtgttaaggctggctttagcaaggattatgatcaatacaactatttttactacaataattatttttcttctatgagacccagaatcctgactccacttgcagacaggaatatatatgttgagcctgacttttttttctggtatatgtaaaatacttcccaggaatacattgggcacttttgggaataatggttaaatcattcaggttgtgcttcctgcccccaaaacagatctacaaaatgataccaaacctgaaagatttaacggatttacggtgcctgcattccacacaacctcacacttagctttgtatttcaaatgaatttgcataaaanctgttcactttancaccttatagtcaaaactttttatggctttcctcccatgggcaatgcttgatcttcccaacatataaactctggcatattttgttcatatgtttgttcctttttggttgtacagactatttacttgttcagaaaacatcgagatctcccaatttgttctttaccccgcccttaaaaggaatttaaactctttcagaagatcgcccttcaccacatctccacagatcacaagctaaggtgaatctggaatatancgtctgcacaaaattttgtgactcagaaaganctttgtaactacnctgaaatacatataataacaatgttccagttacagaggaatattgttggggcaggaagtgaagaaacancttcaagaaacccactttacnctccagttcacaactagctttatattagaaaaacttgggattggaaagtcagccagccagccggccacctgcagcnttgttgataaatgaatactttttcacaccatttatgaaaacaaancttcaactctgttgcctgttatatttaagaaaaattgctgtttctactcnctgtatctgattttaaaaggaaaaaaatattcacgcctggctttcaggacattgactttgaatncttacgagcaaaggncgttgtgtttttcttgcncgtgccgaattc

SEQ ID NO: 2429 - DNA, 1183 bp, Rattus norvegicus
  Genbank Accession No. NM_053772
ggctgtaaagagcactgttcctcaggctagagtccctgctatgtggatatttgttagcaatgactgatgtggaaactacgtatgcagattttattgcctcaggaagaacaggtagaagaaatgcaatacatgatatcttggtttcctctgcaagtggcaacagcaatgaattagccttgaaattagcaggtcttgatatcaacaagacagaaggtgaagatgatggacagagaagctccacagaacaaagtggcgaagcccagggagaagcagccaagtctgaaagctaacactccattctgacggtcatcaacacctgacgatgtggcgaatctcctggcattgctcggatgaatttgcggccatgggtgaaacggaggagaagaaaatggccgtgatgaatggcaagaagccgttggttgccatgtcacgaatgggggcagagctgtgtctgcacacagcctttcccccacctctctcattagcaatggttgaaatcacctggcctgtgcttggatatcatttttgtatgggtcctttcacttgaccgtttaatgaaatgcttgtagagagtagcactgacctagctgatgattcctgtagcatctggcccctcatgatgtcagaggatttaattgtgtctaattgaaaagggttggttgaaccccagagtttccatatctctggctggagtattggctcaccaaaagaaccatccagagagcacagttagcattatgtctctgtgtgtgagtgctgtgttatttacaccgttttgtatcgtacagtatacctgctcagcactgccctttgattgcttatgtaaaacaaaatgaagtacattgactgtgaatttttataccactcatttttttaaagggctgcctttttaatttcccatagtgttgtggtgtgcacggggcagaacctgcttttgtaaaacacgaatttcctcttgatgacttctgagggttatatccaacagactcactgagccccctttgctttattatacaggcatgtggaaatatccattaatgtgaatattgcctgagttcagttttagtatctacacagaccagtgttctgtctgtcaatattgattttatttccaagtaagttctttcagctaacaacttcatttttcatgattaagaatttttaagaattgacaaggtagacc

SEQ ID NO: 2430 - DNA, 1860 bp, Rattus norvegicus
  Genbank Accession No. NM_053783
gcacgagctcgggcggcgcgggtaccctgtctagggtgtcctttgctcaggaatgggcccgcagctgcagtcggcaggatgattctgctggtggtcctgatgctgtctgcggagatcgggagtggagctttgatgagcaccgaggatcctaagccgccctcggtgcctgcgccaacaaatgttctaattacgtcctatgacttgaaccctgtcgtacattggaagcaccagaacgtgtcgcaggctgccgtcttcactgtacaggtaaagatgtatccagaatactggactgatgcctgcaccaacattgcccatcattattgtaatatctacaaacacatttcctatcctgactcatctgcctgggccagagttaaggccaaggttggacaaagagaatctgcctatgcgcagtcagaagagtttattatgtgccgaaaggggaaggttggaccgcctggcctggacatcggaaggaaggaagatcagctgattgtccacatatttcaccctaaggtcaatgtgagtcaggaaaccatgtttggtgacggaaatacctgttacacattcgactacactgtgtttgtgaaacattacaggagtggggagatcctacatacagaacatagcgtcctaaaagaagattgtagcgaaactctgtgtgagttaaacatctcagtgtccacgctgaattccaattactgtgtttcagtagttggaaagtcgtctttctggcaagttaatacagaaacatcaaaagacgcctgtatcccctttctccatgatgacagagaagaatcaatttggatgctgcttgttgctcctcttctcttccttacaatagttgtcccggcacttgtgtgttgttacattaagaagaatccatttaagagaaaaagcataatgttacctaagtccttgctctctgtggtaaaaaatgccacgtccgagaccaaacctgaatcaaagtactcccttgtcacgtcgtgccagccagctgtcctagagaacgagacagtgatctgtgaggagcacttgtccacagtgacaactccagacagcctagaagcaccagagcaggaagaactttctaaaggaaccgtggctacggttgctgaaggaaacacttcccccgagaccaccgacagccctctaactccggtacaaagtggccatttttccctgtcaagtagtaaccagtcaggctcctgtagcctcaccacctatcactccagggacggctctgacagtggcctcgtgggcacaggcagctccatatctgactctgactttctcccaaacaacgactcggaaacaaagatggcagacccagcccctacacctgtgaggaaggccctgactttctccggttatgacaaaccacacgtgttggtggacgtgcccgtggatggggagggcaaggagtctttgattgggtatagactcacgggtgatacccaggaactgtcctaaggccgccgagtcctgacggtgctgaaggatctgcctctaggcagttttcctgctttgttctcgtgaaagactttgcacgttagccgattctgaccgcagcgtccctaatgtgacacccggataaggagtctgtgtgagcgcactgcccggtctactccgcaaatgccaagactgccagagggatgaacagtcacctatgagctcctgcctgggtgggctggttctcctcctctagccttgcttcctccagccgctgctcctccacctcactgcctcacgggacacgggggacctgtcctcacacacctttgtatctgtaagtccgtgtatatagtgtgtttgcagtttcactttaagggaaagctgaaagccactgcaggtgactcc

SEQ ID NO: 2431 - DNA, 7140 bp, Rattus norvegicus
  Genbank Accession No. NM_053795
gtcctctgacaaggtctgcggccctgtgagctggctctacagagccgagggcggagtcctcagccaggccgagatacggtgaattaaagtcggcaatagatttctgtgaaaatgtcagttcttatatcacagagtgtgataaattatgtggaagaagagaatattcctgctctgaaagctcttcttgagaagtgcaaagatgtagatgagaggaacgagtgtggccagacgccgctgatgctggctgcggagcagggcaatgtggaaatagtgaaagaactgttaaagaatggagccaactgcaatctggaagatctggataactggactgcccttatatcggcatctaaggaggggcacatccacattgtggaggagctgctgaagagcggggccagtctggagcaccgagacatgggtggatggacagctctcatgtgggcgtgctacaaaggcaggaccgacgtggtcgagctgcttctttctcatggtgccaacccaagtgtcactggtttgtatagtgtctacccaatcatctgggcagcgggcagaggccatgccgacatagtgcatcttctactgcagaatggtgcgaaagtcaattgctccgacaagtacggaacaacccccttggtatgggctgcccgaaagggtcatttggaatgtgtgaagcacttgttggccatgggagctgatgttgatcaagaaggagccaattcgatgactgcacttatcgtggcagtgaaaggaggctacacacagtccgtgaaagagattttgaaaaggaatccaaatgtgaacctaactgacaaggatggaaacacagctctgatgatcgcatcgaaggagggacatattgagattgtgcaggacctgctggacgccggaacatacgtgaacatacctgacaggagtggggatactgtattgatcggcgctgtgagaggtggtcatgttgaaattgttcgagcacttctccaaaaatatgctgatatagacattagagggcaggacaataagaccgcgctgtattgggccgttgaaaagggaaatgcgacaatggtgagggatatcctgcagtgcaatccggacacggaaatatgcacgaaggatggtgagacaccactgataaaagccaccaagatgagaaatattgaagtggtggagctgctgctggataagggggctaaggtgtctgctgtggacaagaaaggggacactcccctgcacgttgccatccgagggaggagccggagactggccgaacttcttttacggaaccccaaagatggacggttactctacagacccaacaaagcaggcgagactccctacaacattgactgcagccaccagaaaagcattttaactcaaatatttggagccagacacttgtctcctacggaaacagatggcgacatgcttggttatgatttgtatagcagtgccctggccgatattctcagtgaacccaccatgcaaccacccatttgtgtgggcttgtatgcacagtggggaagtgggaagtctttcttactcaagaaactagaagatgagatgaagacgtttgcaggacagcagaccgagcccctcttccagttctcgtggctcatagtgttcctcaccctgctgctgtgtggcgggctcggcctagtgtttgctttcacggttgatacaaacctcgccatagccatttcattgagtttcctggctctcatatatatattcttcatcgtcatttacttcggtggacggcgggaaggagagagttggaactgggcctgggctctcagtaccagactggcaagacacattgggtacctggagctcctcttcaaactgatgtttgtgaacccacctgaactgccggagcaaactacaaaggctttacctgtgaggtttttgtttacagattacaatagactctccagtgtgggaggagaaacttccttggctgaaatgatcgcgaccctctcagatgcttgtgagagagaattcggctttttggctacccgtctttttcgagtcttcaggactgaagagtctcagggtaaaaagaaatggaaaaaaacatgctgcctcccctcttttgtcatctttctttttattgttggctgcattattgctgggatcacccttctggctatattcagagttgacccgaaacatctgacagtgaatgctatcctcatttctatcgcatctgtcgtggggttggccttcgtgctcaattgtcgaacatggtggcaagtgctggactctctcctgaattctcagagaaaacgcctccatagtgctgcctccaaattacacaagttaaaaagtgaaggattcatgaaagtcctgaagtgtgaggtggagctgatggccaggatggcaaaaaccattgacagcttcactcaaaaccagacaaggctggtggttatcattgacggcctggatgcctgcgagcaggataaagtccttcagatgctggacactgtccgagttctgttttcaaagggcccttttattgccatttttgcaagtgatccgcatattatcataaaggccatcaaccagaacctgaatagtgtgcttcgtgactcaaatataaacggacatgactacatgcgcaatatagttcacttaccagtttttcttaatagtcgtgggcttagcaatgcaaggaaattccttgtaacttcagcaacaaatggggacattacatgctcagacaccacaggaacacaggaggacactgacagaagagtttcacagaacagccttggggagatgacaaagcttgggagcaaaacggctctcaacagaagggacacttaccgcagaagacagatgcagagaaccatcacgaggcagatgtcctttgatctcacaaagctgctggtcactgaggattggttcagtgacatcagccctcagaccatgagacggctactcaatattgtttctgtgacagggcggctactaagagccaatcagattactttcaactgggacaggctagccagctggatcaacctcaccgagcagtggccgtaccggacgtcttggcttatactatatctggaagagactgaaggtctccctgatcagatgaccttaaagaccatctatgagagaatatcgaagaatatcccaacaactaaagatgttgagccgcttcttgaaattgatggagatataagaaactttgaagtcttcttgtcttcaaggactccagttctcgtggctcgagatgtaaagacctttttgccgtgcacagtaaacctggatcccaaacttcgggagatcatcgcagatgtccgagctgcaagagagcagatcaacataggaggcctggcctatcccccgctccctctgcacgaaggccctcctcggccaccttctgggtacagtcagcctgcatctgtctgctcttcagcatctttcaacgggccgttcccaggcggggttgtgtctccacagccccacagcagttactacagcggcttgtccggaccccagcaccccttctacaacaggccattctttgccccatacctttacacgccaaggtattaccctggcggttcccaacatctcatctcacgttcatcagtaaaaacgagtttgcccagagatcagaacaatggcctaccgtgtgactctgggtttaacaaacagagacaggcagccgtccctgccacaggcagctcactgttactgagttcaatgaccgtggatgtcgtatgtgagaaactgagacagatagaagggctggaccagagcatgatgcctcagtactgcacaacaatcaaaaaggcgaacataaatggccgggtattgtctcagtgtaacattgatgagctgaagaaagagatggctatgaactttggagactggcatctcttcagaagcatggtcttagaaatgagaagtgtggaaagccaggtggtccctgaagaccctcgttttctcaatgaaaactccagtgccccagttcctcatggagagtctgctcgccgctcttctcacactgagctgcccctcacggagctttccagccagactccatacaccctgaacttcagctttgaagaactgaacacgcttggccttgatgagggagcccctaggcacagtaacctgagttggcagtcacaaactcgcagaaccccaagtctctcgagtctcaattcccaggactccagtattgaaatttcaaagcttactgataaggtgcaggccgagtatagagacgcctatagagagtacattgctcagatgtcccagttagaagggggcacagggtcgtccacaataagcggcagatcttctccacatagcacatactacataggccagagctcttcagggggctccatccattctactctagaacaggaaagggggaaggagggtgagctaaagcaggaggatgggcggaagtcatttttaatgaagaggggggatgtcatagattactcctcatcaggggtgtccactaatgaggcctcacccctggaccccattactgaagaagatgagaaatccgaccagtcaggtagtaagctactcccaggcaagaaatcctcagaacggcccagtctcttccagacagacttgaagcttaaggggggtggtcttcgctaccagaaactgcccagtgatgaagatgagtcggggacagaagagtcagataacaccccactgctcaaagatgataaggacaaaaaggctgaaggcaaagcagagagagtgtgcaagtccccagagcacagtgccgagcccatcagaacgttcattaaagcaaaagagtatttgtccgatgccctccttgacaaaaaggattcctcagattcgggagtgaggtccaatgagagttctcccaaccactctctccacaatgaggcagcagacgactcccaactggaaaaggcaaacctcatagagcttgaagatgagggccacagtgggaagcgggggatgccacacagtctgagtggcttgcaagatccaattatagctcggatgtccatttgctcggaagacaagaaaagcccttccgagtgcagcctgattgctagcagccctgaagaaagctggcctgcgtgccagaaggcctacaatctaaaccgaacgcccagcactgtgactctgaacaacaacactgcacccaccaacagagccaatcagaacttcgatgagatagagggaatcagggagacgtcccaggtcattctgaggcctggccccagtcccaacccaactgctgtgcagaatgaaaacctgaagagcatggcgcacaagcgaagccagcgctccagttacacaaggctctcgaaagatgcatctgagctacatgcagcctcctcggagagcacaggctttggagaagagagagagagcattctctgatgaggaaggagaagtgaaaagagtgtgacagactttgagttgaccattcctcattactcatcatgtttatgcatcacagacacctgataggtggtcaggcactggaagcagacaggaaagcctgaaagcacagtcaccagtcattttcattgtcaccgtcatcccaggcactttaaagtctcactgccactattacacctttcctggcacacagctaggcagagcgatgagagcaggctgaagacaaaataggtcaaaagtgtatttaaagttgaaagggcttaaatcacaaggaaaaaaacttagagatctcctttataaactattcatgtaccatttgagggaagatacagtgttagatgaagcagaaaccaattttattgttagtgtttaatcttggtgcagatttataagttttagagtagcccagagactaaaagtgaatacttagcaaatggatagccagtgttctatataggaatcattgcttttcagagggcttaaagtttaagtagaaaatatatactcaagaaggcgataaaagctgatgagaaagtgagttagcagaacccaaagccgtgctgggccgcggtgactcattagcagaggaggaggggagggcagtatattcctgggatactctctccagacccagcctggcttctgacatcatccacctgtgccctcaaaaccgtcttagtctgttctgcaactcttaagtgacatacctaactcagctcatggctaaggaaaaaaaattaaagttgtcctggtgattaaactctggacctcccacatctaagtcccgagttgacaaactgcatccccagcccaaacatctgttcttccagagatctggaaagacatgggcataagagtccagtaaactcttaatgaaggtgtcgggaagtgtttcccttaaaggggttagtgacagtgacactagacaagtgacagaatttagtttgctgacattaaatcactgccttctgggccgcaatagtttagtatctgttcctaaatcagcatttgagttctgcgggggttacaaaatggaggcatggttttaagaaggaatttgaaagcatccagggaagcaagaacagagtcggagctggtgtgaccatgacacttcccattattgttagcaaagctaggagaatgaccacatacatttaagtatcatgtaggctagagcgtgcctgtcatcatcatgcattgagaccgtttgtcctttgattatagtgtgtttatgtagaccagtcctagcagtatgtcctgagccatgggcaggattgtagatggcgaggtggcaggtttagtgctcgttgagatgtccatctctgactggacctgtgtggtttacttgtagctgctccgtgaaacactgccttgctgtttgagtgtaattgagcattttcatgaagtgtatatgttgcatgatctttaacaggtatttttagacattaagaacagcatgatattactgacatatgcattagtagtatgcagtatcatgtaatgggtacttcagaggcagtttggtttctttccaggtgagtagttatagctcacagtcatgggaatcctttattcacactgtctgtgaagtcgatgctggagtgccaaatgcacacggagactaggaacaataaagacttgcatgccattctgactcatggagttttattcaatagagcaatgataattcccattctgattaaaaattaaaacacggaa

SEQ ID NO: 2432 - DNA, 2143 bp, Rattus norvegicus
  Genbank Accession No. NM_053799
ggagtctgggggcttaaaacaaggactgggagggccagcctgcgggagggagacgttttttagcctgtcctacggaagcctgcgagggagggtggtatccactcccccaatccagtgtcctgatgcccagcgccaacgccagccgtaagggtcaggagaagccgcgggagatcgtggacgcggcggaagattatgctaaagagagatatggggtatcctctatgatacaatcacaagaaaaaccagatagagtgttggttcgagttaaggatctgacagtacaaaaagctgatgaggttgtttgggtccgtgcaagagttcatacaagcagagcaaaagggaagcagtgcttcttagtcctgaggcagcagcagtttaatgtccaggctcttgtggcggtgggagaccatgcaagcaagcagatggtgaaatttgctgccaacatcaacaaagaaagtattattgacgtagaaggcattgtgagaaaagtaaatcagaaaattggaagctgtacacagcaggatgttgagttgcacgtccagaagatttatgtgattagcttggctgagcctcgcctgcccttgcagctggatgatgccattcggcctgaggtggaaggagaagaggacgggagagctaccgttaaccaagatacaagattagacaacagaatcattgaccttaggacatcaaccagccaggccatcttccatctccagtccggcatttgccatctcttccgagaaacgttaattaacaaaggttttgtggaaatccagactcctaaaataatttcagctgccagcgaaggaggagccaatgtttttactgtgtcttattttaaaagtaatgcctacctcgctcagtctccacagctatataagcagatgtgcatttgtgctgattttgagaaggttttctgcattgggccagttttcagagctgaagactccaatacccatagacatctgactgaatttgttggtttggatattgaaatggcctttaattatcattaccatgaagttgtagaagagatcgctgacactttggtgcaaatattcaaaggacttcaagaaaggtttcagactgaaatccaaactgtaaacaaacagttcccatgtgagccgttcaaatttttggagccaactttaagactggagtattgtgaggctttggctatgcttagagaagccggagttgaaatggacgatgaggaagatctgagtacaccaaatgaaaaactgttgggtcgtttggtgaaggaaaagtatgatacagacttttatgttcttgataaatatccattggctgtaagacctttctataccatgcctgacccaagaaatcctaagcagtccaactcttacgatatgttcatgagaggagaagaaatattgtctggagcacaaagaatacatgatcctcagttgcttacagagagagctttacaccatggaattgatttggagaaaataaaagcttacattgattccttccgctttggagcccctcctcacgctggtggcggcattgggttggaaagagtgacgatgctgtttttaggattgcataatgtacgtcagacctcaatgttccctcgtgacccgaagcgactcacgccttaaagccacactttttattctctctttgattagcttatacctgaggtacttaagatatgcagtagaattaatgcattactaaagtgccacaattattttttaagtagctcaatacgaattcatttaagtcaaaacgttttagaacttcagatatgcttaaataggaaatacttgaacattttaatgagaaatttctatggttgaaattcatagtctatcactataggaaatgttaaggacaatttaaacagtttaggattatataatttttttttcttttctatattgtggtgaccaccatactaatatcctaaattttcaatatttgaacttttaactcttgacattgagaaaaaaaaattggagaaattaccaagattttaacatatataaaactggtatgtcttaaaagttactttcagaaatcatgtaaagtatctgaaaacactggctagaagcagtaacactgaaaccttgttatcaattctgaggctgaaattcaataaaaacttaaagct

SEQ ID NO: 2433 - DNA, 330 bp, Rattus norvegicus
  Genbank Accession No. NM_053800
atggtgaagctgatcgagagcaaggaagcttttcaggaggccctggccgctgcgggagacaagcttgtggtagtggacttctctgccacgtggtgtggaccttgcaaaatgatcaagcccttctttcattccctctgtgacaagtattccaatgtggtgttccttgaagtagacgtggatgactgccaggatgttgctgcagactgtgaagtcaaatgcatgccgaccttccagttctataaaaagggtcaaaaggttggggagttctctggtgctaacaaggaaaagctcgaagccactattacggagtttgcctaatcatgctctgaa

SEQ ID NO: 2434 - DNA, 3286 bp, Rattus norvegicus
  Genbank Accession No. NM_053814
gacatgtcggcggccaaggaaaacccgtgcagaaaatttcaggccaacatcttcaacaagagcaagtgtcagaactgcttcaagccccgcgagtcgcatctgctcaacgacgaggacctgacgcaggcaaaacccatttatggtggctggctgctcctggctccagatggcaccgactttgacaacccagtacaccggtcacggaaatggcagcgacgattcttcatcctttatgagcatggcctcttgcgatatgccctggatgagatgcccaccacccttcctcagggcaccatcaacatgaaccagtgcacagatgtggtggatggggaggcccgcacagggcagaagttctccctctgcatcctaacacctgacaaggaacattttatcagggcagaaacgaaggagatcatcagtgggtggttagagatgctcatggtatatcctcgaaccaacaagcagaaccagaagaagaaacggaaagtagagccacctacgccacaggaacctgggcctgctaagatggctgtcactagcagtagtggtggcagcagtggaagcagcagcagcagcagcagcagcagcattcccagtgctgagaaggtccccaccaccaaatccacactctggcaggaagaaatgagagccaaagaccaacctgatgggaccagcctgagtccagttcagagtcccagccaaagccaacctcctgctgcttgcaccccacgggaaacagggctagacagcaaagaagatgaaaacattttaagtggggaccgtgtggatggtggtcggaaagtacgggtagaaagcggctacttctccctggagaaggccaagcaggacctgagggctgaggaacagctgcccccactactctctccacccagccccagcaccccacacagcaggaggtcccaggtaattgagaaatttgaggccttggacattgaaaaggcagagcacatggaaaccaacatgctgattctgaccactccatccagtgacactcgtcagggccgcagtgagagacgggccatccctagaaagcgggactttgccagcgaaacccccacagctcctctctcagatgcttgtcccctgtctccacaccgaagagccaagtcattggacaggaggtccacagaatcctccatgacgcctgacctgctgaatttcaagaaaggctggctaaccaagcagtatgaggatggccagtggaagaaacactggtttgtcctggcagatcagagcctgagatactacagggattccgtggctgaggaggcagctgacctagatggagaaattaacttgtccacttgctatgatgtcactgagtatccagtccagagaaactatggctttcagatacataccaaggagggtgagttcaccctgtcggccatgacatctggcatacgacggaactggatccagaccattatgaaacatgtgctcccaacatctgccccagatgtgaccagctcattgcctgagggaaagaataaaagcacatcttttgatacctgcttaaggccaagtgagaagcaagaagctgagccaggagaaccagatcctgagcagaagaaaagccgtgcacgagagcggaggcgggagggtcgctccaagacctttgactgggctgaattccgccccatccaacaggccctggctcaagaaagggccagcactgttgggtcttctgattctggtgaccctgggtgtctggaagccgagccaggtgagctggagcgtgaacgagctcgacggcgagaagaacgccgcaagcgctttgggatgctggacaccaatgatggaccaggaatggaggatacagccctacgtatggacattgaccggagcccagggctgctgggaacccctgacctcaagacacagaatgtccatgtggaaattgagcagcggtggcaccaagtggagaccacccctctcagggaggagaaacaggtgcccattgcccctctgcacctatccttagaggacagaagtgagcggctctccacacatgagctcacctctctgctagagaaggagctggagcagagccagaaagaagcttcggatcttctagagcagaatcggcttctgcaggaccagttaagggtggccctgggcagagaacagagtgcccgggagggctatgtgctgcaggctacatgtgagcgaggctttgccgccatggaggagacacatcagaagaagattgaagatctacagaggcaacaccagcgggagctagagaagctgcgggaggaaaaagaccgtctcctggctgaggagacagctgccaccatatcagccattgaagccatgaagaatgctcaccgagaggagatggaacgggagttagagaagagccagcggtctcagatcagcagcatcaattcagacatagaagccctgaggcgacagtacctggaggagctacagtcagtgcagcgagagctggaggtcctttccgagcagtactctcagaagtgcctggagaatgcacacctagcccaggcgctggaagctgagcggcaagccctgcggcagtgtcagcgtgagaaccaagagctcaatgcccacaaccaggagctgaataaccgcctggctgcggagatcacacggttgcggacactgctgactagagaaggtggtggggaatccactgggttgcctctcacacagggcaaggatgcctatgagttagaggtcttgttgcgggtcaaagagtcagaaattcagtacctgaaacaggagatcagctctctcaaggatgaactccagacagccctgcgggataagaagtatgcgagcgacaagtacaaagacatctacacagagctcagcatcgcgaaggccaaggctgactgtgacatcagcaggctgaaggagcagctgaaagcagccacagaggcactgggcgagaaatctcctgaaggcactactgtgtcaggatatgacataatgaaatctaaaagcaatcctgacttcctgaagaaagacagatcctgtgttacccggcaactcagaaacatcaggtccaagtccgtaattgagcaggtctcatgggataactgagtcgcgcccgcttccaagtcccctgtcgtagtctgaaggaaggcctgacggtgcaggagcgcttgaagctctttgaatccagggacttgaagaaagattagctgcatccattccactgacacatccttcccagctggtggcagcacaagccaagagtgggtttcatctgtgctttctcattgttgctgtcata

SEQ ID NO: 2435 - DNA, 740 bp, Rattus norvegicus
  Genbank Accession No. NM_053819
cggactcctagagacacgctagagcagataccacgatggcgccctttgcatctctggcctctggcatcctcttgttgctatcattgatagcttccagtaaagcctgtagctgtgccccaacccacccacagacagctttctgcaactcggacctggttataagggctaaattcatgggttccccagaaatcatcgagaccaccttataccagcgttatgagatcaagatgactaagatgctcaaaggattcgacgctgtgggaaatgccacaggtttccggttcgcctacaccccagccatggagagcctctgtggatatgtccacaagtcccagaaccgcagcgaggagtttctcatcgcgggccgtttaaggaacggaaatttgcacatcactgcctgcagcttcctggttccctggcataatctgagccctgctcagcaaaaggccttcgtaaagacctatagtgctggctgtggggtgtgcacagtgtttccctgttcagccatcccttgcaaactggagagtgacagtcattgcttgtggacagatcagatcctcatgggctctgagaagggctaccagagcgatcactttgcctgcctgccacggaatccagatttgtgcacctggcaataccttggggtctcgatgacccgaagccttcccctggcaaaagctgaagcctgaacactgtttacctttcctccatctttctttctcttaaatggtgaaataaag

SEQ ID NO: 2436 - DNA, 2074 bp, Rattus norvegicus
  Genbank Accession No. NM_053821
cggcggctccctcagctcctcatctgggccatctgtccgtgtgtcgctgcctcagaccagcaggatggctgccaacaaaggcaagagccagggctccctggtccttcacaaggtcatcatggtcggcagtgggggagtcggcaagtcagccctgacgctccagttcatgtatgacgagtttgtagaagactatgagcccaccaaagccgacagttacagaaagaaggtggttctcgacggagaagaggttcagatagacatcctggacacagccggccaggaggactatgcggccatccgtgacaactacttccgaagcggagaaggctttctgctggtgttctccatcacggagcacgagtctttcaccgccacagccgagttcagggaacagatcctccgagtcaaggccgaggaggacaaaatccctctgctggtcgtgggcaacaagtctgacctggaggagcggaggcaggtgcccgtggaggaggcccgaggcaaagcggaagagtggggtgtgcagtatgtggagacatccgcaaagacccgagccaacgtggacaaggtgttctttgatctgatgagagaaatccgggcaaagaagatgtcggaaaacaaggacaagaacggcaggaaaagcggcaagagcaagaagagtttcaaagagcggtgctgcttgctgtgagcgggccgcggacagagcgagcggagaaggccacattgcagcgcgccgagcccaggtggcctccccctggctccccgtctccagcagctgtaattcactatcacttcttgaagatggacagatacctgtgcaaaccagtggctggcaggagaaagacgcacttcgtctgtgcgtctgtgcgatgcatctgctaacgttgccaggagctttgagagtctgccccctcccaccctccctgaaccgtgactgtcaccagactctagggtcaggaatctgagttgtgttgacaagaaagaggattgccacggcggcttgtccccccctgttctaggacatggtcatcttttgttggaaaatcaaaatgcttcacattagcagggcgtgctggtgcacccctgtagtcccagaactctagaaggtaaggcagggagggtagcctgagcccaaggccccaaggcctgggctacctagcaagaccctgtctctaaaaggaaaaagaactaacatcttattttcttagatttaaaaagagggtctctggcaagacccctcgttagttcttatcagtttagaagtagacagggggcggaaaacctaagctcaggtaatactgaaaaagccaaaacaatttgttttttttttttttttctgttttaaaagataaacttctgtgacttggaagcagaattagaaagatgaacttcacttggtccagataggctgaaccaagcctcctggcgtttgtagagaagtgggacgctgttcccttcatacttaaatgccagccaggtgctggctgtgggcttccctccctaacacccttacttagtagtgaggaaactttgtgtgggggagatgtagcctgtgccccagaacaagctttcttttttctgactggatcatctcaccttttctggttccctcccactccagccataggcctgttctttttcttcctttctgaaaaatgtgaccagttcaaattatgtcccaggacacgggccagcgccagctacctctgcagactctacaagcggaagaggggaaggctcagaagggagggccatctcctgtagctcccggcagttggttctggtgacactgacatgaaccaggttccagaggctcacacccactctctgttaagcctcctctcggggaaggggactctgggactgggggctgccactgagcacacacactcctcccattttccagaagtgaacatttcacttttggtgccgaatgtgaatctgggtgggaagagcgggagcccttctaatggatttttttttacagagttatggaatccaaggtctgatccctggaaacttgtgtcacttccaaagaatcatgggctttttcgaattaaaaaaaattacacttttc

SEQ ID NO: 2437 - DNA, 361 bp, Rattus norvegicus
  Genbank Accession No. NM_053822
gcacgaggtgaaaggaaatttttatcgacatggcaactgaactggagaaggccttgagcaacgtcattgaagtctaccacaattattctggtataaaagggaatcaccatgccctctacagggatgacttcaggaaaatggtcactactgagtgccctcagtttgtgcagaataaaaataccgaaagcttgttcaaagaattggacgtcaatagtgacaacgcaattaacttcgaagagttccttgcgttggtgataagggtgggcgtggcagctcataaagacagccacaaggagtaacagagcttctggcctgggctgggtcccttggatatgtctacagaataaagtcgtcatatctt

SEQ ID NO: 2438 - DNA, 982 bp, Rattus norvegicus
  Genbank Accession No. NM_053835
gggagctgacagcagccacgcggggaagatggctgaggacttcggcttcttctcgtcgtcggagagcggggcccccgaggccgccgaggaggacccggcggccgccttcctggcccagcaggagagcgagattgctggcatcgagaatgactcgggtttcggggcacctgccgccagccaggtggcctctgcgcagcccggactcgcgagcgggggtggttcggaggacatggggactacagtcaatggagatgtgtttcaggaggctaacgggcctgccgatggctacgctgcgattgcccaggcggacaggttgactcaggagcctgagagcatccgcaagtggagagaggagcagaagaaaaggctgcaggagttggatgctgcctcgaaggtgaccgaacaggagtggcgggagaaggccaaaaaagacctggaggagtggaaccagcgccaaagtgaacaggttgagaagaacaagatcaacaacaggatcgctgacaaagcgttctaccagcagccagatgctgataccattggctatgtggcatcggaagaggcttttgtgaaagaatccaaggaggagaccccaggcacagagtgggagaaggtggcccagctgtgtgacttcaaccctaagagcagcaagcaatgtaaagacgtgtcccgcctgcgctcggtgctcatgtccctgaagcagacgccactgtcccgctagtgcctgtcaccacgggccttggtggggcagagcagcagctgcttcagccagggtggaacttctctggcagctgccacacacgcctgttctgttcctctgagtctctgggagctgggaagcgggacccttacccctttcacccaccctgtccttcctggtcccctgttccagcccctcatgactcctgtcagtccacttgattgtgactgtccctcctgatgtatttttcttggcttaaagggtgtgttaactctttttacactt

SEQ ID NO: 2439 - DNA, 1816 bp, Rattus norvegicus
  Genbank Accession No. NM_053837
cgggcggccgctgactcaggtctgttctcagagcaatgggtcacagagactgagctgccgccatgatcggaggcttattcatctataatcacaagggggaggtgcttatctcccgagtctacagagatgacatcgggaggaatgcagtggatgcctttcgcgtcaatgtcattcacgcacggcagcaggtgcgcagccctgtcacaaacatcgctcgcaccagcttcttccatgttaagcggtccaacatctggctggcagcagtcaccaagcagaatgtcaatgccgccatggtcttcgaattcctctacaagatgtgtgatgtaatggctgcttactttggcaagatcagcgaggagaacatcaagaacaatttcgtgctcatatacgagctgctggacgagattctggactttggctacccacagaactcagagacaggtgcactgaaaaccttcatcacccaacagggtatcaagagtcagcatcagacaaaagaagagcagtcccagatcaccagccaggtgaccgggcaaattggctggaggcgggaaggcatcaagtatcgtcggaatgaactcttcctagatgttctggagagtgtgaacctgcttatgtccccacaggggcaggtgctgagtgcccatgtgtcgggccgggtggtgatgaagagttacctgagcggcatgcctgagtgcaagtttggaatgaatgacaagattgtcatagaaaagcagggcaaaggcacagccgatgaaacaagcaagagtggtaagcagtcgatcgccattgatgactgcacctttcaccagtgtgtgcgactcagcaagtttgactctgagcggagcatcagctttatccctcctgatggagagtttgaactcatgagataccgtactaccaaggacatcatcctgcctttccgggtgatcccattggtgcgggaggtgggacgcaccaaactggaggtcaaggtggtcatcaagtccaacttcaagccctcacttctggcccagaagattgaggtgaggatcccaaccccattgaacacaagcggggtgcaagtgatctgcatgaaggggaaggccaagtacaaggccagcgagaacgccattgtatggaagatcaagcgcatggcaggcatgaaggaatcacagatcagcgcagagattgagctcctgcccaccaatgataagaagaaatgggctcggccccccatttccatgaactttgaggtgccatttgcgccttctggcctcaaggtgcgctacttgaaggtatttgagccgaagctgaactacagcgaccacgatgtcatcaaatgggtgcgctacattggccgaagtggcatttacgaaacccgctgctagctgccccgctgcggctggcccacatcctgcccaccctttccacaggtccaagcacccccagtgaccgctcaccagtgtcgttcctccctcctgctctgcctccttcccttcccaatagcccctgagtataggtctgaaccggccacatcacagtgggactggtcaggcagtccctagcttcctgggagggtggtttttgaggcttctgtctgtctgtcctggcttagtgccaggccctgagttttgtgaccaaagccaggtggtcccctcttctctctaccctgtggccacacctctgcagtgggaaggttgaatacccttacctcagagctcccccaacggccagtaacggatccccagtcattagtccctactctgctttgggatagtatgagcttcgttttgtacacgtgtgactttgtccagttataaacccaataaactgt

SEQ ID NO: 2440 - DNA, 1318 bp, Rattus norvegicus
  Genbank Accession No. NM_053843
acctcatcagactctgacccagttcttgaatgactttggagacccagatgtttcagaatgcacattctggaagccaatggctactcccaccactgacaatgttgctgctgtttgcttttgcagacaggcagacggcaaatcttccgaaggctgtggtgaaacgtgatcccccatggatccaggtgctcaaggaaggcactgtgacgctgacgtgcgaagggacccacaatcctggaaactcttctacccagtggttccacaaccagagctccacctggggccaggtccaagccagctacacgtttaaggccacagtcaatgacagtggagaataccggtgccgaatggcgcacaccagcctcagcgaccccgtacatctggaagtgatttctgactggctgctgctccagacccctcaactggtgtttgaggaaggggaaaccatcacattaaggtgccatagctggaagaacaaacagctgactaaggtcttgttgttccagaatggaaaacctgtgaggtattattatcaaagcagcaatttttcaatccccaaagccaaccacagtcacagtgggaactactactgcaaagcatatctaggaaggacaatgcatgtgtccaagcctgtcaccatcactgtccaaggttcagcaacggcatccaccagctctctagtgtggttccatgccgctttctgcctagtgatgtgcctcctgtttgcagtggacaccggcctgtatttctgtgtacggagaaatcttcaaacctcgggggaggactggaggaaatccctgtcagtcggaaagtacaaggctccacaggacaaatgacatcccatcgtatggctaaacagcggcagcttcttttcagccacaccgccgcttcatctacagccttcctttgaaagcaacttaccaccaggctggatatttggtcctgcaatcacaactgctaggaggctgaggcaggagggtcaccaaaggctgcccgggttttagagaagagagagtgcaagtctatcctggataacccaataagaccctgggtttagatggcttatcaggaaagagcacccattgctaagctcacagacaagaccacagattgatccctaaggacacagggcaaagggagagaacaaattcctgaaagttgtcctctgacctccacacgtccaccatggcagatgcacacaataaacaaattaaaatgtaatatatatattttaaacaagaggtggggaaaggctgggggttggtggcacagtttttatccaggacacatgatgctctggattttgacctcctataataaa

SEQ ID NO: 2441 - DNA, 6436 bp, Rattus norvegicus
  Genbank Accession No. NM_053846
ggaaggcgggggaggggctccaccgcccccgtcgccggcgttgccttccggggacgtggacacgtgagccccagcggctgggtccatggcattgtgaatcgacgagggagccccgctccgcgcgaggggcgcccggccccctccccgccccatgcgcccgcggctctgaagcctgagcggggccgggggccgggcggcgtcggggccgccggaggcatggctctcgggagtcggtggcgaccgccaccccagttgccgccgctgctgttgttgctggcgctggtggcaggcgtccgtggcttggagtttggcggcggccccgggcagtgggctcgctacgcgcgctgggcaggcgcggcgagcaccggcgagctcagcttcagcctgcgcaccaacgccacgcgcgcgctgctgctctacctggacgacggcggcgactgcgacttcctggagctgctgctggtggacgggcgcctgcggctgcgcttcacgctgtcttgcgccgagcccgccacgctgcagttggacacgccggtggccgacgaccgctggcacatggtgctgctgacccgcgacgcgcggcgcacggcgctggcggtggacggcgaagcccgtgcggccgaggtgcgctcaaagcggcgcgagatgcaggtggccagcgacctgttcgtgggcggcatcccacccgacgtgcgcctgtctgcgctcacgctcagcaccgtcaagtacgagccgcctttccgcggcctcctggccaacctgaagctgggcgagcggccgccggcgctgctgggtagccagggtctgcgcggtgcggccgccgaccccctgtgcgcgcccgcacgcaatccctgcgccaacggcggcctctgcaccgtgctagcccccggcgaggtgggctgcgactgcagccacactggcttcggcggcaagttctgcagtgaagaggaacaccccatggaaggtccggctcacctgacgttaaacagcgaagtagggtccttactgttctccgaggggggggccgggagaggaggagccggcaatgtgcaccagccaacaaaaggcaaggaggaatttgtggcaaccttcaagggcaatgagtccttctgctacgacctgtcacacaacccgatccagagcagcactgatgagatcacactggccttccgcaccctgcagcgcaacgggctgatgctgcacacggggaagtcggctaactacgtcaacctgtccctcaagtccggggctgtctggctgatcatcaacctaggctcaggtgccttcgaggccctcgtggaacccgtcaatggcaagttcaacgacaacgcctggcacgacgtccgggttacccgaaacctgcgccagcacgcagggattggacacgctatggtaaacaaactgcattatctggtgaccatctcggtggacgggatcctgaccaccacaggctacacgcaggaggattacaccatgctgggctctgatgacttcttctacattgggggcagccccaacacagccgacctgcctggctcccctgtcagcaacaacttcatgggctgtctcaaggacgtggtctacaagaataatgacttcaagctggagctatcccgactggctaaggaaggggacccgaagatgaagctgcagggggatttgtctttccgttgtgaggacgtggctgccttggaccctgtgaccttcgagagtcctgaggcctttgtcgcactgccccgctggagcgccaagcgcactggttctatctccctggacttcagaaccacggagcccaatgggttgctgctcttcagccagggccggcgggctggggccggggtaggcagccacagttccagccagagggccgactactttgccatggagctattggatggctacctctatcttctgctggacatgggctctgggggcatcaagctgcgggcgtccagccgcaaggtcaacgacggcgaatggtgccacgtggacttccagagggatgggcgcaaaggctccatctctgtgaacagccgcagtacaccattcttggccacaggagagagtgaggtcctggacctggagagtgagctgtacctgggcggtctccctgaggggggccgagtggacctgccattgcctcctgaggtgtggacagctgctctccgggctggctacgtgggctgcgtgcgagacctcttcatagatggacggagtcgagatctccggggcctggctgaggcacagggagctgtgggcgttgcacctttctgctctcgggagaccctgaagcagtgtgcatcggccccctgtcgtaatggtggcatctgtcgagagggctggaaccggttcgtctgtgattgcatcgggaccggctttctgggtcgggtctgcgagagagaggccacagtcttaagctatgatggctccatgtacatgaagatcatgctgcccaatgccatgcacacggaagcagaggatgtgtccctgcgattcatgtcccagagggcttatggactcatgatggccaccacctctagggagtcggccgacactctgcgtctcgagctggacggggggcagatgaagctcacagtcaacctcgactgcctgcgcgtcggctgcgcacccagtgctgcagctaaaggccccgagaccctctttgcggggcacaagctcaacgacaatgagtggcacacgctgagggtggtacggcgtggcaagagcctgcagctgtctgtggacaacgtgactgtggagggacagatggcaggagcccacacgcggctggagttccacaacatcgagacaggcatcatgacagagcgacggtttatctctgtggtgccctccaacttcatcggccacctgagcgggctggtgttcaatggtcaaccctacatggaccagtgcaaagatggagacatcacctactgtgagcttaatgcccgctttgggctgcgtgccatcgtggctgatcctgttaccttcaagagtcgcagtagctacctggcgttggccacgctccaagcctatgcctccatgcacctcttcttccagttcaagaccacagcccctgatggacttctgctgttcaactcaggcaacggcaatgacttcattgtcatcgagctggtcaaggggtacatccactacgtgtttgacctgggaaatagcccgtccttgatgaagggaaactcagacaaaccagttaatgacaaccagtggcacaacgtggtggtgtccagggacccaggcaacgtgcacacgctgaagattgactcccgcacggtcacgcagcattccaacggtgcccgaaatctggatctcaaaggggagttgtacatcggtggcctgagcaagaacatgttcagcaacctgccaaagctggtggcctctcgggatggctttcagggctgcctggcttctgtggacctcaacgggcgcctcccagacctcatcgcagacgccctgcaccgaatcgggcaggtggagaggggctgtgatggccccagtaccacctgcaccgaagagtcctgtgccaaccagggcgtctgcctgcagcagtgggacggctttacctgtgactgcaccatgacttcctatggaggccctgtctgcaatgaccctgggaccacatacatctttgggaaggggggagcgctcatcacctatacatggcctcccaatgaccgacccagcacaaggatggaccgcctggccgtaggcttcagcacccaccagcggagcgctgtgctggtacgcgtggacagtgcctccggcctcggggactacctgcagctgcacattgaccagggcactgttggggtgatttttaatgtgggcacggatgacattacaattgatgagcccaacgccatcgtgagcgacggcaaatatcacgtggtgcgcttcactcgaagtggtggcaatgccactttgcaggtggacagctggccagtcaacgagcggtacccggcagggaactttgataacgagcgcctggcgattgctagacagagaatcccctaccggcttggtcgagtagtagatgaatggctgctcgacaaaggacgccagctgaccatcttcaacagccaggctgccatcaagatagggggccgggatcagggccgccccttccagggccaggtgtccggcctctactacaatgggctcaaggtactggcgctggccgccgagagcgaccccaatgtgcggaccgaaggccacctgcgcctagtaggggaagggccgtccgtgctgctcagtgcagagaccactgccaccactctgctggccgacatggccaccaccatcatggagaccaccaccaccatggccaccaccactactcgccggggccgctcccccacaatgagggacagcaccacccagaacacagatgaccttctggtggcctcggctgagtgtccaagtgatgatgaggacctggaggagtgtgagcctagtactggaggagagttaatattgcccattatcacggaggactccttagacccccctcccgtggccacccggtcccccttcgtgcccccgccccccaccttctacccctttctcacgggcgtgggtgccacccaagacaccctgcctccgcccgccgcgcgccgcccgtcctccgggggcccgtgtcaggccgagcgcgacgacagcgactgcgaggagcccgtggaagcctcgggcttcgcctccggggaggtctttgactccagcctcccccccacggacgacgaggacttttacaccaccttccccttggtcacggaccgcaccaccctcctgtcaccccgcaagcctgcgccccgacctaacctcaggacagatggggccacgggcgcccccggggtgctacttgcgccctccgccccagcccccaacctgcccgcgggcaaaatgaaccaccgagacccactgcagccgctgctggagaacccacccctggggcctggggtccccacggccttcgagccgcggcggccgcctcccctgcgccccggcgtgacctcagtccccggtttcccccgtctgcccacagccaaccccacgggtccgggggagcgcggcccgccgggcgcggtggaagtgatccgcgaatccagcagcaccacgggcatggtggtgggcatcgtggcggcggcggcgctctgcatccttatccttctctacgccatgtacaagtaccgcaaccgcgacgagggctcctaccaagtggaccagagccggaattacatcagtaactcggcccagagcaatggggcggtggtgaaggagaaggcccccgctgcccccaagacgcccagcaaggccaagaagaacaaagacaaagagtattacgtctgagcacccagtccaggcaccgcgccccactgccagctgctcctcccgggaaggcccgggaggagggtgcggccctctccctgcagggggatctggggaccctctccccggctgcctcaggcttctcccacgaagaggaaacgcaaaaagaaaaggaatataactactacgtgctcatccccttccctcccactgccctcggcgccgcactgtcagctctggggctggctgtcctccgctctgcgcctgtcaggcagggcacgtgctcacagccctgggttgatttattttttaaggggcgtagttttattttggtggggctgggcgggaaggaaggctggggttttgtaaagtgtccactgcgccgttcgtttatttccctcgattttcttcttcctcccagctcctcccgccttccttcttcgcagccctcctgtcctggttcaggcttgctgtgtcttttgtccctaccctcctccaccccatcccccctttctttccttttcttttctcttcttttcctttctttcttttttaaattctgttttctctgcttcccttcctttgggtttccagagtcgctgggagaagaagggtgggcttgggtggctggggccgggcagtggggctcattcccctggtgccgcaagtcccctcgtgaggagaaactcctgcctgggtctgcccaaggattgggcttggacctggccaaggcctgttgtgtgtgtcgctgccgggcaacgtgcattgctgggaagccgctggaggagcggggtggggggcggggggagggggaaaggcaaatgcagatatatattaaaaacaaataaccgaggtaccagagctgcgtctgtggcaccagctcgctgcaggcgcagaggatggtgggagtgaggctgtgtctgcggatggctggggtcacttctccgcccatgggctccctgctcccccagttttttttctctttgttaacaaatgtgtctgagtcttggaaaacaccccaaacccggaaatgtgtgggaaaaagaaaacaaaaactttccaaattccaaaaaaaaaaaaaaaaaaaaaaaaa

SEQ ID NO: 2442 - DNA, 3927 bp, Rattus norvegicus
  Genbank Accession No. NM_053851
tttttgtaacttacttgttttagtatatactgatctgaacaggcaaaaccccatgttagcaacagctcggtcaggaagagaaatgctaccttttctagatgtttgccgggaggcagccccctgaaaggagatctcaaattacctgtaagaaaaaaaatttttttaaaggcagtcagagagagcaaagttttggcatgcctgcaaaaacagcagtgtctgtaaaaactacctagagacagcagctaagtgttgatttgcccatgactcttacctgggagtggaaggtgggaagaaatggacagtggccgtgacgagaagctgaggcacggtgcagcttggtgaagccacgctctgactgcgtcctgccacctcttcatgcagtgctgcgggctggtacatcgccggcgagtacgggtgtcctatggttcggcagactcctacaccagccgcccatccgattcagatgtgtctttggaagaggaccgggaggcagtccgtagagaagctgagcggcaggcccaggcccagttggaaaaagcaaagacaaaacctgttgcatttgcagttcggaccaatgtcaggtacagcgcagcccaggaggatgacgtcccggtgcccggcatggccatctcattcgaggcaaaagattttctgcatgttaaggaaaaatttaataatgactggtggataggacggctggttaaagaaggctgtgaaatcggatttattccaagcccggtcaaactagagaacatgaggctacagcatgaacagagagccaagcaagggaaattctactccagtaaatcaggaggaaattcatcatccagtttgggtgacatagtacccagttccagaaaatcgacacctccatcatctgctatagacatagatgctactggcttagatgcagaagagaatgatattccagcaaaccaccgctcccctaagcccagtgcaaacagtgtaacgtcaccccactccaaagagaaaagaatgcccttctttaagaagacagagcacactcctccttacgatgtggtaccatccatgagaccagtggtgttggtgggcccctccctgaaggggtatgaggtcacagatatgatgcaaaaagcactgtttgattttctaaaacacagatttgaaggacggatatccatcacaagagtcactgctgacatctccctggccaaacgctcagtattaaacaaccccagtaagcacgcaataatagaaagatccaacacaaggtcgagcttagcggaagttcagagtgaaattgaaaggatttttgaacttgcaagaacactgcaattggtagtccttgacgcggatacaattaatcacccagctcaactcagtaagacctctctggcccctatcatagtgtatgtaaagatttcttctcctaaggttttacaaaggttaataaaatctcgaggaaagtctcaagcaaagcacctcaatgtccagatggtggcagccgataaactggcccagtgtcccccgcaggagtcatttgatgtgatcttggatgagaaccaacttgaggatgcttgtgagcatctcgccgactatctggaggcgtactggaaggccacccaccctcccagcagtaacctccccaaccctctccttagccggactttagccacctcaactttacctctgagccccacccttgcctctaattcacagggttctcaaggtgatcagaggactgatcgctctgctccccggtctgcttcccaagctgaagaagaaccttgtctggaaccagtcaaaaaatcccaacaccgttcttcctcagccacacaccaaaaccaccgcagtgggacaggtcgaggcctctctaggcaagaaacgtttgactctgaaacccaagagagccgagactctgcctacgtggagccaaaggaagattattcacatgaacatgtggaccgctatgttccacaccgtgaacataaccacagagaggagagccacagcagcaatggccacaggcacagggagcctcgccaccgcactagggacatgggtcgagaccaagaccacaatgagtgcagcaaacaacgaagccggcataaatctaaggatcgctactgtgacaaggaaggggaagtaatatccaaaagaaggagtgaggctggcgagtggaacagggatgtatacatccgccaatgaccgtgcgtgtctctgcccccaagtcttgtgtaacatcatccttaagcaaaatctttggggctccattgcaaccatctgtgatctgtcttgtatattttgtattgctgttgcttgaatagcaatagcatgcaatcaagtattactatacattcttttgtaagtaccacagaaattggcctagtacaagctgcagtcctcagtctatatcctgaactcttcaaaagctgtttggggtagctgccacctgaacagagtggcttcagaaatatagttaatgtattcagtgagccagatgcagcacagataacaagtggaattcctccatatttttaatacccagatacctgacctgtcattctttcatggaccactgtttcttgcttgtacctctggctgactaaatttggggacagattcagtcttgccttacacaaaggggattataaagttagaatctattttctatgtactagtactgtgtactgtgtagacagtttgtaaatgttatttctgcaaacaccttattataattatatatataatatatatatatatatcagtttgatcacacaattttagggtcttaatgccaagtcagcagatttgctttatgaatcacagggactagaaatgcccacattcaggaaatttctaatattgtctagactcctctccctattctaagagagagcctgtatatagtgtaaatacgtgtgattgcttgacttgaggtttgatttctgaatgtaatcccatccttgtaagtttttcattttaaccataaattatggtaaatgtaaccaactccagaggtttttctactccatacagtccacactgattgtgacaaacacgttcttagcagctagtgtctgtggtagtcactgcactggagtatccaagcggagcccaccatgtgcacatgcgtgtgtgagtgtgagagtgagtggctgagacgaagtggaatgcagaagactaatgcggaaaccagaggctgatggacctggctttgcatttaactgttgtatgttgctttcgaacccactgagcagccagggaatgtgaggaagcttgctgccaaaggaactagggaagcacttagtggctgactccctgcttttgcccctgaagagagaaaacatgggcgtcttgtactgtgagtgttccactggaaatggacaatctttgtgtgtcagagtattttgttttagtaagaaatgtttacacagcttgtgcaattatttcgtagggaaataaatttttataacttgtcccacttcactttctaaacgtgcctattgctcctcttgttcatcctcagccaccgctcttcttcccctgcaccaagctgtgcagctgcactgtcggaatctagaagtgcttcttagaaccaaagttcctgctaaatctttagaagttatcagggcaaaaatggaatgacttgaagcaaaaaaagttgaaacattttcttttacgagacatctctaagggagaacgtagaagacacttttttcacacctcaatttgctttcgttaagaagcttaaactgctcttagccgaggctatccaatctctgtctctcaagagcccagtgctgatggagaggtaagactgtatgagctccacacgcccctagcattcgaagccttcgcaggaaaatgtctatctgtgattacccaaccagatcagtatatactaaaacaagtaagttacaataaatatatttttgttttgtt

SEQ ID NO: 2443 - DNA, 2533 bp, Rattus norvegicus
  Genbank Accession No. NM_053853
ggagaggagaggagagggaaagccagccaagaacacatggagagaggggaggggatgtggaaagagggagaaggcgcagagagtaagagagcaagggcgtcaaacagcccctttaagagtaagccaggcatgcctggctaatgccaggtaactgtgggggcagagcctagaggggatgctaacagagctcatctcagtccactcttctcacccagtctgccccagtcaccctgtctttgtatccaccccttctgctaggaaacaccatcctcacacatccgtggagctcactgtctgtcatccttcggatgcaagtgtggctttcttcatccatattagttcccatcaaaactctccttctacctctctattttagttatcctgtggacagctactacacttctcttttttgtttttaaattacttatgtattattttaatacccactgaaatgcaagattttggagggcaagaaagcatagcaagtatctaaaggatgttcagtgaagggatgacttggtcaatcagtgtagctcattcagtaaggagcctcatagagcacccagtgcagtgatgaatgggtcactcgccatggcattctctagtgtgtaagtctcccatttttgtgaataactgtttgaaagattattttggcaatatctacctttcatcaccaaggtaaccacatctaatctctcttttgactggtcatttagccttattttctacctcaaaaacttgaaagatacaaggaataacaaaactttcctctaaggctctctgagagtatttaatgaacagcaggtaaaagcaagccaggctgtagaggtgacatgattgcctaggagctatgtagaggcatctttcatgtatacacgttaacaacacattcgaactacagttagctgactctgggacacccagaagaattgatgtcatgtttgtctgctttcatcctgtttgccttagggagccatggacatcgaagcatacttcgaaaggattggttacaagaactcagtgaataagttggacttggccacattaactgaagttcttcaacaccagatgcgagcagttccttttgagaatcttagtatgcactgtggagaagccatgtgtctgggcttagaggccacttttgaccacatagtaaggaaaaagcggggtgggtggtgtctccaggttaatcatctgctgtactgggctctgaccaaaatgggttttgaaaccacaatgttgggaggatatgtttacataactccagtcaacaaatatagcagtgaaatggtccaccttctagtacaagtgaccatcagtgacaggaactacattgtggattctgcctatggaagctcctaccagatgtgggagcctctggaattaacctcagggaaggatcagcctcaggtgcctgccatctttcgtttgacagaagagaatggaacctggtacttggaccaaatcagaagagagcaggatgttccaaaccaagagtttgttaactcggacctccttgaaaagagcaaatatcgaaaaatctattcctttactcttgagccccgcactattgaggattttgaatatgtaaatacctaccttcagacatcgccagcctctgtgtttgtaagcacatcgttctgttccttgcagacctcagaaggggtttgctgtttaattggttccacccttacaagtaggagattcagttataaggacaatgtagatctggttgagtttaagagtctgactgaggaagaaatagaagatgtactgaaaaccacatttggcatttctttggagaaaaagtttgtgcccaaacatggcgaactcgtttttactatttagggtaaattgttctccattattatctcagtcttaaacattctaaaaatatgcaaatacatatccataacagaaatcgcacagctcaatattgatcaactaatgacctgtatcttctatttcctacattttatacaaaacgaaacccagttgtcctgtcatttcaccaataaaaataccgccagttataatgaaataaacctgatcatggatgtaacgacaatcctctcaacattaatcaacaaaaattacttatcgaagaggtggcgatcttgggagccatattcatttacaaacctcccaacatcattttatggttgaactcagatgaaaaatgaatgaatatgaatgatcagagaacagcaggaagtaaagtcaggcagactaaatctgaggtccaaggtttacaagaaaccacctgtacaacttaggattagaataaagcaaagaagaatgaaccatcattacaggtccaggtaacttcccagtcctcaaaacagaactcacgccagtggacctgggctctgggattaggtgccaagacaatgacacggcttagaaggcttagaatttcttccagagataattttgcagacacagttctttttgtatctgattttttttaactatgagaatactggtattaagtgatttataccttatatataataatctttgtagcctataa

SEQ ID NO: 2444 - DNA, 843 bp, Rattus norvegicus
  Genbank Accession No. NM_053857
gggccgaggtgccgcggggttgctggagggtcgtgggcggcgtgcaggagacatgtcggcgggcagcagttgcagccagactcccagccgggctatccccactcgccgcgtagccctcggcgacggcgtgcagctcccgcccggggactacagcaccacccccggcggcacgctcttcagcaccaccccgggaggaaccagaatcatctatgaccggaaattcctgatggagtgtcggaactcgcctgtggccaaaacacccccaaaggacctgccaaccattccaggggtcactagccctaccagcgatgagcctcccatgcaggccagccagagccatctgcacagcagcccggaagataagcgggcaggtggtgaagagtcacagtttgagatggacatttaagggaccagccataggacgcagtgatgcttctgggcccctggggcccttgggaggagagccacagcagtcaggccttgtacccggcagacactgggtgtggatcggccacccagtcctgctcctcactcagggcacctgctctgccttccattttgtgaataccagcacatacctccttgtgcctctgttgatactgagctgctactccagggtaatgactctcacctacaccctccctgcatcaagcgccagcgagtggacacagaggagtctgtcggaatgatctggcaattctagccccaacctctggagcacacccaccttaccttaggttggggtacctgggaaagccaccctttacttctttccctgagaggaaataaaagccacatttaccctaggcccacagccgggccctgtctgaaaaaaaaaaaaaa

SEQ ID NO: 2445 - DNA, 2870 bp, Rattus norvegicus
  Genbank Accession No. NM_053864
gaattccggcgtttgcagccgtcgtttgattagtcgcctctcgcggattaggagctagcgtctcccgcccgcctgccgccccggtgccgctgggaggaagcgagagggaggctgcctgtgggtttgtcactgctgttgctcctccacctgagtgagtcaagcccgggcctagtcggtcgcctaccattctcgtagccgttaccctcaggccgccacagccgccgaccgggagaggcgcgcgccatggcctctggagccgattcaaaaggtgatgatttatcaacagccattctcaaacagaagaaccgtcccaatcggttaattgttgatgaagccatcaatgaagataacagtgtggtgtccttgtcccagcccaagatggatgaactacagttgttcagaggtgacacggtgttgctaaaaggaaagaagagaagggaagctgtatgcattgttctttctgatgacacgtgttctgatgagaagattcgaatgaatagagttgttcggaataacctccgagttcgcctaggagatgtcatcagcatccagccatgccctgatgtaaagtatggcaaacgtatccatgtgctacccattgatgacacagtggaaggcatcactggcaatctttttgaggtataccttaagccgtacttcctggaagcatatcggcccatccgtaaaggagatattttccttgtccggggtgggatgcgtgctgtggagttcaaagtagtagagacagatcccagcccttactgtattgttgctccagacacagtgatccactgtgagggggagccaatcaagcgagaggatgaggaggagtccttgaatgaagtaggctatgatgacatcggtggttgcaggaagcagctagctcagataaaggagatggtggagctgccactgagacatcctgcactctttaaggcaattggtgtgaagcctcctcggggaatcttgctatatggacctcctgggacagggaaaaccttgattgcccgagctgtggcaaatgaaactggagccttcttctttctgatcaatggtcctgaaatcatgagcaaattggctggtgagtctgagagcaaccttcgtaaagcctttgaggaagctgaaaagaatgctcctgccatcatcttcatcgacgagcttgatgccattgcacccaaaagagagaaaactcacggggaagtggagcgtcgcatcgtgtctcagttgttgacccttatggatggcctaaagcagagagcacatgtgatagttatggcagcaaccaatagacccaacagcattgacccagccctacggcgatttggtcgctttgacagagaggtagatattggaatccctgatgctacaggacgtttggaaattcttcagatccataccaagaacatgaaactggcagatgatgtggacttggaacaggtagccaatgagactcatggtcatgtgggtgctgacttggcagccctgtgttcagaggctgctctacaggccatccggaaaaaaatggacctcattgacctagaagatgagaccattgacgctgaggtcatgaattccctggcagttactatggatgacttccggtgggccttaagtcaaagcaacccatcagcacttcgggaaactgtggtagaagtgccacaagtaacctgggaagacattggaggcctggaggatgtcaaacgggagcttcaggagttggttcagtatcctgtggagcatccagacaaattcctcaaatttggcatgactccttccaaaggtgttcttttctatggaccgcctggctgtgggaaaaccttactggccaaagccattgctaatgaatgccaggctaacttcatctccatcaagggtcctgagctgcttaccatgtggtttggggaatctgaggccaatgtcagggaaatatttgacaaggcacgacaagctgccccctgtgtactcttctttgatgagttagattcaattgccaaggctcgtggtggtaatattggagatggtggtggagctgcagaccgagtcatcaatcagatcctgacagaaatggatggcatgtccacaaaaaagaatgtgtttatcattggagctaccaaccggcctgacatcattgatcctgctatcctaagacctggccgtcttgatcagctcatttatatcccacttcctgatgagaagtcccgtgttgccatcctaaaagccaatctgcgaaaatccccagttgccaaggatgtggatttggagttcttggctaagatgactaatggcttttctggagctgacctgacagaaatttgccaacgtgcttgtaaactagccattcgtgaatctatcgagagtgagattaggcgagaacgagagaggcagacaaatccatcagctatggaagtagaagaggatgatccagtgcctgagatccgcagagatcactttgaggaagccatgcgttttgcccgacgttctgtcagtgataatgacattcggaagtatgaaatgtttgcccagacactgcagcaaagtcgaggttttggcagcttcagattcccttcagggaaccagggtggagctggcccaagtcagggcagtggaggtggcacaggtggcaatgtgtacacagaagacaatgacgatgacctctatggctaagtgatgtgccagcatgcagcgagctggcctggctggaccttgttccctgggggtgggggcgctcgcccaatgggaaccaggggtgtgcccatggcctgttccattcctcagtccgaacagttcagccccagtcagactctggacgggggttttctgttgcaaaaaaattacaaaagcgataaaataaaagtgattttcatttggga

SEQ ID NO: 2446 - DNA, 2451 bp, Rattus norvegicus
  Genbank Accession No. NM_053866
tgagctgctcgctaccgggccacgaactggacgtgaggggcctggtgtgctgcctctacccaccgggagcctttgtgtctgtgtcccgggatcgtaccacccgcctctgggctccagacagtcctaacaggggctttacagaaatgcactgtatgagcggccactctaattttgtgtcttgtgtgtgcatcataccctcaagtgacatatatcctcatggactaattgccactggaggaaatgaccacaatatttgcattttctcgctggacagtccgatgccactttatattttaaagggtcacaaagatactgtttgtagtctttcttctggaaaatttgggacattacttagtggctcatgggacaccactgctaaagtctggctgaatgacaaatgcatgatgacattacagggtcacacagctgcagtatgggcagtaaagattttacctgaacagggcttaatgttaactggatcagcagacaaaacaattaaactatggaaggccggaagatgtgagaggactttttcagggcatgaagactgtgtaagaggtttggcaattttgagtgaaacagaatttctttcctgtgcaaatgatgctagtattagaaggtggcagataactggcgagtgtcttggagtatactacggacatacaaattatatttatagcatatctgtctttccaaattgtagagattttgtgacaactgcagaagacagatctctaagaatatggaaacatggtgaatgtgcccaaacaatccgacttccagctcagtctatatggtgctgctgcgtactggacaatggtgacattgtggttggtgcgagtgatggtattattagagtgtttacagaggcagacgagcggacagccagtgccgaggaaatcaaggcttttgagagagagctctctcaggcaactatagactccaaaactggcgacttgggggacattaatgctgagcagcttcctgggagggaacatctgaatgagccaggtactagagaaggacagactcgtctaatcagagatggagagagagttgaagcctatcaatggagtgttagtgatggcaggtggataaaattggtgatgttgttggctcatctggtgctaatcagcaaacatctggaaaagttttatatgaagggaaagaatttgattatgttttctccatcgatgtgaatgaaggcggaccatcatataaattaccatataatgtcagtgacgacccctggctggttgcatacaacttcttgcagaaaaatgatttgaatcccatgtttctggatcaggtggctaaatttattattgataacacaaaaggtcaaacactgggacttggaaataccagtttttcagacccatttacaggtggtggtcgctatgttccaggaacttcagggccttccaacacagtgcagacagcagatcctttcacaggtgctggtcgttatatgccagggtctgcagggatggataccaccatggctggagttgatccatttacaggaaatagtgcctaccgatcagctgcgtttaaaacagtgaatatttatttccccaaaaaagaagctcttaccttcgaccaagcaaaccctacacaaatattaggaaaactgaaggaacttaatggaagtgcacctgaagagaagaagctaactgaagatgacttggtacttctggaaaagatactgtccctgatttgtggtaatgcttcagaaaagccgacggcccagcagcttcaggttctgtggaaagccatcaactggcctgaagacattgtctttcccgcacttgacattcttcggctatcaattaagcatcccagtgtgaatgagaatttctgcaatgaaaaagaaggagaccagttcagcagccaccttatcaaccttctgaaccctaaaggaaagccagcaaaccagctgcttgctcttaggactttttgcaattgctttgttagtcaggcaggacaaaagctcatgatgtcccagagggagtcattgatgtcacatgcaatagaactgaaatccgggagcaataagaacatcatattgctctggctacactgaccttgaactattctgtttgtttccataaagaccataacattgaagggaaagcccaatgcttgtcagtgattagcacaatcttggaagttgtacaagacctagaagccacatttagactccttgtggctcttgggacacttatcagtgatgattcaaatgctatacaattagccaaatctttaggtgttgattctcaaataaaaaagtatgcttctgtatcagagccagctaaagtaagtgaatgctgtagacttgtcttaaatttgctgtagcagtggggaaaggaagctgaggggttttcttttttttgttttgttttgttttgtttttttccacattttacatgactgattggagatgattta

SEQ ID NO: 2447 - DNA, 2538 bp, Rattus norvegicus
  Genbank Accession No. NM_053880
gagggacgttcccggaaagttaccggtcagaagaaactatctccacatcaccacctgacaggtcacaaccatgtcagacaaaagtgaattaaaagctgagttggaacgtaagaagcaacggttggcccaaatcagagaagaaaagaagaggaaagaagaggaaaggaaaaaaaaagaaactgatcagaagaaggaagctgcagtctctgtgcaggaagagtctgaccttgaaaagaagagaagagaagccgaagccttgcttcagagcatggggctaactacagactccccaattgttttttctgagcactgggtccctcctcccatgtctccatcctccaagtcggtgagcacgccaagtgaagctggaagccaggactctggagatggcgccgtgggatctaggacgctgcactgggatacagatccatcagctcttcagctccactcagattccgatttgggacgaggacctattaaacttggaatggccaaaattactcaagtcgactttccccctcgagaaatcgtcacatatacaaaggaaactcagaccccggttacagctcaacccaaagaagatgaggaggaggaagatgacgtagcagctcctaagcctcctgttgaacctgaagaagagaaaattttaaaaaaagacgaagagaatgatagcaaagctccccctcatgaactaactgaagaagaaaagcaacaaattttacactcagaagaatttttaagtttctttgaccattctacaagaattgtagaaagagccctctctgagcagattaacatcttctttgactacagtgggagagatttggaagacaaagaaggggagattcaagcaggtgctaagctgtcattaaatcgacagttttttgatgagcgttggtcaaagcatcgagttgttagttgcttggattggtcatcccagtatccagaattacttgtggcttcctataataacaatgaagaggctcctcatgagcctgatggtgtggccctcgtatggaatatgaagtacaagaaaactaccccagagtacgtgttccactgccagtcagctgtaatgtctgctacatttgcaaaatttcatccaaatcttgttgttggaggtacatactcaggccaaattgtgctttgggataaccgtagcaataaaagaacccccgtccagagaacaccactgtcagctgctgcacacacacaccctgtctactgtgtaaatgttgttggaacacaaaatgctcataatctgattagcatctctactgatggaaaaatttgctcctggagcttagacatgctttcccatccacaggatagcatggagttggttcataaacagtcaaaggcagtagctgtaacatctatgtctttccctgttggagacgtcaacaactttgttgtgggcagtgaagaaggttctgtgtatacagcatgccgccatggcagcaaagccggaatcagtgagatgtttgagggacaccagggacccatcacgggaatccactgtcacgcagctgttggcgcagtagacttctcacatctgttcgtcacttcgtcttttgactggacagtaaaactttggtcaactaagaataacaagcctttgtactcatttgaagataattcagactatgtctatgatgttattgggtcacccacccacccagccctgtttgcctgtgtggatggcatggggagactggatctatggaatctcaacaatgacacagaggtgccgactgccagcatttctgtggagggcaaccctgcccttaaccgtgtgagatggacccactcgggaagagagatcgccgtgggtgattctgaaggacagattgtcatatatgatgtgggcgagcagatcgctgttccccgaaatgatgaatgggcaagatttggccgaacactcgcagagattaacgcaagccgagctgatgcagaggaggaagcggctacccggattcctgcctaggcctggagggtggccgtagccttatcgagtctggcaaagaggatgaagtagatcctaaactattttgcatgcttctgattaaacgagaattaaaagaaaactccatggatagactgggtttaatacaggaagcaaagcttaccgaagcccttttatattctattccctttgctttggattggtgtcatttttaatacagctgacaactttacagaatgcagccttttctgaattctaacacatggggtgtatattgttaattattcttttggattcttttgaacttgtactactatatataattatttctaaagcacagactaagtgagttctgcatatttctaaagagccacgagtcccttattaatgcaatacagtacatgggtccttgtcagttaatgtcctcactgccctgagtgagtaggaacattgttcttagtgccagcatcgattcgcctacctgttttaagtttcatgttgatgccgttttccttctctatagttcatggatgttatctataaataaaaacaaatatgtgctaacttaaaaa

SEQ ID NO: 2448 - DNA, 667 bp, Rattus norvegicus
  Genbank Accession No. NM_053884
ggcacgaggggcatcactgctgtttggggagccttctgccgggccgacaggatggcgggcaggggtaaactaatcgcagtgattggagacgaggacacggtgactggtttcctgttgggcggcataggggagcttaacaagaaccgccaccctaatttcctggtagtggagaaggataccaccatcaatgaaatcgaagacactttcaggcagtttctaaacagggatgacatcggcatcattctcatcaaccagtacatcgcagagatggttcggcacgccctcgatgcccaccagaggtccattccagccgtcctggagatcccgtccaaggagcatccctacgacgcagccaaagactccatcctgcgcagggccaagggcatgttcactgctgaagacctgcgctagggctgctcagcccttaaccctcctctcgcttccaggcctctcccagtttgccaccctctatttaagtttcaagccttggtttccagcccctcccttcctcttcactgagtggttcctaagctgttggggttctgatgttcaggtccaggctgggtagggaaagaaaggccaaccatctctccactacctatgccattgagcagtatcattgttaacattaaaggaatattctctccgaaaaaaaaaaaaaaaaaaa

SEQ ID NO: 2449 - DNA, 6659 bp, Rattus norvegicus
  Genbank Accession No. NM_053885
  misc_feature (1)..(6659): n = a or c or g or t
gcacgagccccgcgctccgcagnctctagcccctccgggcctcggtccccgccttcttccccgcgcctcgtcccctcacgcgctccccaccttgtctccgcctcgttttctctcctggttgaagggaaggaaaaaaaaaaacatctaccatcctcctgtgggagcctctcgccctctggggaaaaaaaaaatccacaaaaccagacatggtcctgggntcccactgttgaaggtttggcccacccgaggaggtcgaagtcccggaagggaagccccgnagccccccggggtcgaatccccgggggccggttccctcggccccgggcccgccgccttcggtccgccgccggtccctgggggctcccacccggtcccctgcacttttccccggagcccggccgccacccctctcattgatggtgtagcgtctgaggggaagcatttttgaaacgttggggttgttggagtggttggattttccctggaattgagtaagaaattcagaagactgaagcccaggctcactgtctacctttcacggaggcctagccgtgagaggacagaagaaggcacgtggngaatcatgacagctgacaaagataaagacaaagacaaagagaaggaccgggaccgggaccgggaccgagagagagataaaagagacaaagctagggaggagcgagaacgccaggcctcggaggagctgcacgttggagggaggagccaagaactatgctgaaagtgacacagtgaggacgaagacaacgacaaacggagccaccacggaggagtccgccaggaagagcagaaagaaacctcccgaaaaaaaagtcccgcttacgagaggacagacactggggagataacgtcttacatcactgaggatgatgttgtttacagaccaggagactgcgtgtatatcgagagtcggcggccaaacacaccgtatttcatctgcagcatccaagacttcaaactggtccacaactcccaggcctgttgcagatctccagctcctgctttgtgtgatcccccagcatgctctctgccggtggcatcacagccaccacagcacctttctgaagccgggagagggcctgtagggagtaagagggaccatctactcatgaacgtcaaatggtactaccgccagtctgaagttccagattctgtctatcagcatttggttcaggaccggcataatgaaaacgactctggaagagaacttgtcatcacaggatccagtcatcaaggaaccgggagctcttcatttctgattatgttgacacctaccatgctgctgccctgagagggaagtgcaacatctcccatttttccgacatatttgctgctcgtgaatttaaagcccgagtggactcgtttttctacatattaggctacaaccctgagacaaggaggctgaatagtacccaaggagaaattcgagttggccctagccatcaggccaaacttccagatttgcagccatttccttctccagatggtgacactgtgactcagcatgaggaacttgtcttggatgcctggagtcaagtgacttgtgacctcctcatgtactttgagggcagcaaggagcatggcagccttccgcaggaattgttgttgacggaggttccacagaggatggcttgtgtcgcaggggtcttcgggattgacaacactctcaatgcactgaacacactacatgaaagcagttatgatgccggcaaagccctgcagcgcctggtgaagaagcctgtgcccaagctgatcgagaagtgctggacagaggatgaagtgaaacgcttcgttaaggggctccgacagtacggcaagaacttcttcagaatcagaaaggagctgcttcccaataaggaaaccggggaactgattaccttctattactactggaagaaaacaccggaggcagccagctcccgtgcccaccgccggcaccgcaggcaggctgtgttcagaagaattaagactcgcacagcgtccacccctgtcaacacgccctccagacctccttccagtggaattctgtaagtggggtatcttggcgctgccaagggtagtaagagactgcgcacatgcagacatatctgtgtccagctctaagcctgtgaactggtgagccagggatttgtatggtgtggtttgtgtgttagcgtgtacatgtttgtacattagtgctgacaaactgacaattgtgggagagtttaaaaattattcttacatttaagtatttctaataaatttcaccattctttcacattttgtaaaatataagcttgaccctccgctttcttcttttgtttgctttaccaagcttagcttcctagtcctagtgtgacattcattctaataaaacagggaggccctgtgggttttggcccctaccaactagactgaaacagtagtgctttacagttctgccccagccctgaacactgccctgaggcaccagtgttctgtgtttgctttgtgcgggccagcagccatctaggttcataagagactcccaggccgcgcagatggacgagggcagacagtcctgtgggtgcacggctaccaccccagactcaccggactcacccgtgctggccaccccaggactccagcatgacatcagcctcctggcagggcaggagcttgagtactacccctcacacatgcaagctctttgctctggtgacagcgcctgaggaattagaaatgggcctttgtgacagatgctcattcagtctgtgtggttagttcactgctggtcgcactcccagcggaacatgatggcgtctcttctgtttccacttttgctcaccttgtacagtggatctgagttcggctagtgaggatgactttgacagtgaggacagcgagcaggagctgaaggggtacgcctgccggcactgcttcaccaccacctccaaagactggcaccacgggggccgagaaaacatcctgctgtgcacagactgccgcatccacttcaagaagtacggtgagctgccacccatcgagaagcccgtggaccccccgcccttcatgttcaagcctgtcaaggaggaggacgatgggctcagtgggaagcatagcatgaggactcggcggagtcggggctcgatgtctacactccgcagtggtcggaagaagcagcctgccagtcctgatggccgcgcctcacctgtcaatgaggacgtgcgatccagtggccggaactcccccagcgctgccagcacttccagcaatgacagcaaagcagaggctgtgaagaagtcggccaagaaagtgaaggaagaggctgcgtcccctctgaagaacaccaagcgccagcgggagaaggtggcctccgacacagaagacactgacagggccacctccaaaaagacaaagacccaggagatcagccgccctaactctccctctgaaggtgagggggagagttccgacagtcgcagtgtcaatgatgagggcagcagtgacccaaaagacatcgaccaggataatcgcagcacgtcccccagtatccccagccctcaagataatgagagcgactcggactcatcagcacagcagcagatgttgcagacccagcctccagccttgcaagctcccagtggggctgcctctgctccctccacagcccctccagggacaacccagcttcccaccccagggcctacaccctctgctactacagtccctccacagggctcccctgcaacctcacagccccctaaccagactcagtctacagtggcacctgcagcccacaccctcatccagcagacgcccaccctgcatccccctcggctgccctcacctcatcctccactgcagcctatgactgcaccacctagccagaactctgcacaacctcacccccagccctccttgcatggtcagggccctcctggccctcacagcctacagactggacccctactacagcacccaggacctcctcagccctttggactgactccccagtcctcccaaggtcagggccctctgggtccctccccagcagcagcccatcctcacagcaccatacagcttccagcctctcagtcggcactgcagcctcaacagcccccaagggaacagcccttgcctcctgccccgttagccatgcctcacatcaaacccccacccaccacaccaattccccagcttccagcaccacaggcccacaaacatccgcctcacctctcaggcccctcccccttctcaatgaatgccaatctgccacccccaccagccctgaagcccctcagctcactgtccacacaccatcctccctcagcccaccctccacccctacagcttatgcctcagagccagcccttgccctcttcacccgcccagccccctgggctgacccagagtcagagcctcccaccccctgctgcctcccaccctaccactggcggcctccaccaggtgccctcgcaatccccattcccccagcacccttttgtacctggaggcccccctcccatcaccccaccctcctgcccccccacttccacccctcctgcggggcccagctcctcatcacagccaccctgctctgctgctgtgtcttctggaggcaatgttccaggggcgccatcttgcccactccctgctgtgcagatcaaggaagaggctctggatgaagccgaggagccagagagccctcctccaccccccaggagcccatcccctgagcctactgtagtggacacccccagccatgctagccagtctgccaggttctacaaacacctggaccggggctacaactcgtgtgcacggacagacctgtacttcatgcctctggctggatccaaactagccaagaagagggaggaggccattgagaaggccaagcgggaggctgaacagaaagcccgagaggaacgagagcgagagaaagagaaggaaaaagagcgagagcgggagagagagcgggaacgggaagcagagcgcgctgctcagaaggcttctagctcagcacatgaaggccgtcttagtgaccctcagctcagtggtccaggtcacatgcgaccctccttcgagccaccaccgaccacaattgctgctgtgcccccatatattgggcctgacacacctgccctccggacactgagcgaatatgctcggccacatgtcatgtctcccaccaaccgtaaccaccccttctacatgcccctcaatcccaccgaccccctcctggcctaccacatgcctggcctgtacaatgttgaccccaccatccgggagcgggagctccgagaacgtgagatcagagagcgcgagatccgggagcgggaattgcgggagaggatgaagccaggctttgaggtgaagcccccagagctggaccccctgcacccagccaccaaccccatggagcattttgcccggcacagcgccctcaccatccctcctgcagctggcccccacccctttgcctctttccacccgggcctcaaccctttggagcgggagagactggcgctagcaggtcctcagctgcggcctgagatgagttacccagacagactggcagctgagcgcatccatgccgagcgtatggcgtcactcaccagcgaccccctggcacgactgcagatgttcaatgttactccacaccaccaccagcattcacacatccactcccacctccacctccaccagcaggatcctctccaccaaggttcagcaggcccagttcaccccctggttgaccccctgactgctggccctcacttagctcgcttcccctaccctccgggcaccctccccaatcctctacttggacagcccccccacgagcacgagatgctacgccacccagtttttggcaccccctacccccgagacctgcctggggctattccaccccccatgtcagcggcccaccagcttcaggccatgcatgcccagtcagcagagctgcagagactagccatggagcagcagtggctgcatggacatccacacatgcatggtggccatctacccagtcaggaggattattacagtcgactgaagaaggaaggagacaagcagttataagttatttatttgttatgctgctgtggaaaccccagttctagggggcagaaacaggacttttacatctagtaggcgctgcaagagcaaagaggaatatcgtctaaagatttctctatatttaaacccacaactaaaaacacatctgcatagtagtgtttgtttgttgagaggatttcctgagaccagttgaggtctccctgcatgacagtcccccagaaacggcgtgtcctgggctggactgacacccagaaaacgtacctgcgatcttggggtttggctttagttctcttttccttgatttctcagtaggtgctagagtccgttcacacccttcactgtgcgcgcagacactgaggcacgtgggctctggaacccacggggtttgcaaagaggcggcgtatgagtttgaaatccaagagctataatttttaaaaaatcttttattttactacattgtaggaaatcttcataatttgagacagttctgcagcatggctttttacatctgtaaataaataattttagaagtctttttttctgtccacagacgactattctgatctattttttccagccatgtcacaaagtgt

SEQ ID NO: 2450 - DNA, 1428 bp, Rattus norvegicus
  Genbank Accession No. NM_053897
atgcgaagtctcagcctggcgtggctgctgggaggtatcacccttctggcggcctcggcctcctgcaaccggaccgtgaatgcaccgggacccaacagtaaagggagaagtctgattggcagattggacacgccgcctcccatcactgggaaaggggctccagttgaaccaggcttttccgttgatgaattctctgcatccgtcctcaccgggaagctgaccaccgtctttctcccggtcatctacatcattgtctttgtaattggtttgcccagtaatggtatggccctctgggtcttcttcttccgaacgaagaagaagcaccctgctgtgatttacatggccaacctggccttggcagacctcctctctgtcatctggttccccctgaagatctcctaccacctccatggcaacgactggacctatggggatgcgctctgcaaggtgctcattggctttttctacggcaatatgtactgctccatccttttcatgacctgcctcagcgtgcagaggtactgggtgatcgtgaaccccatgggacactccaggaagagggccaacatcgctgttggcgtctccctggccatctggctcctgatttttctggtcaccatccctctgtacgtcatgaggcagaccatctacattccagccttgaacatcaccacctgtcacgacgtgctgcccgaggaggtcctggtgggggacatgttcagttacttcctctccctggccattggagtctttctgttcccagccctccttactgcgtctgcctacgtgctcatgatcaaaacgctccgctcttccgccatggacgagcactcggagaagaaaaggcggagggctatccgcctcatcatcacggtgctgtccatgtacttcatctgcttcgctcccagcaacgtgctgctcgtcgtgcattatttcctcatcaaaagccagaggcagagccacgtctacgccctctacctcgtcgccctctgcctgtccaccctcaacagctgcatagacccctttgtctactactttgtttcgaaagatttcagggaccaggccagaaacgcgctcctctgccgaagcgtccgcaccgtgaaacgcatgcagatatcgctcacctccaacaagttctccaggaaatccagctcttactcctccagctcaaccagtgttaaaacctcctactgagctgggtctgaggatatggagccagcttgatgatgatgctggtgatgatgatgatgatgatgatggtgatgatgctgatgatgctgatgatgctgatgatgctgatgatgatgatgtatgtgtgtgcaattgtgcgtgcatgcgtgtgtgtgtgtgtgtgtgtgtgtgtgtgtgtgtgttagggatgccaccacaacgcacggggctgtcatttccattccaagttgcactata

SEQ ID NO: 2451 - DNA, 2347 bp, Rattus norvegicus
  Genbank Accession No. NM_053921
ggagcttctgtttccgggtacggtttctgtcacaaagccgagccctcctttcgcaggtggcgtcacgggtcctctgctccgtgcccgaggtcagcaagcaaggacgggcgcttcccagccagccaccggagccgggcctcgcagctctgggactgcagctcgagcgacacgttccttggcccacacctatctccgagtcacgctctgccctgtgaggtgccatgcagaaggactaagactcagcacccgtttgatacaaaacaagttcatgctccctagagtgttcgtgggaaaagtaaatcccagtacacacaagacactatggctgagcatggggctcatatcacaactgcttcggtggcggacgaccagccatccatctttgaggtggtagcacaggacagtttaatgacagcagtgagacccgctcttcagcatgtggtcaaggttcttgcagaatcaaatcctgcgcactatggcttcttttggaggtggtttgatgaaatcttcactctgctagactttctgctccagcagcattatctttctagaactagtgcctcattttctgaacacttttatgggttaaagcggattgtagcggggagctcgccgcagcttcagagaccagccagtgctggcctccccaaggaacacctctggaaatccgctatgttccttgttcttcttccctatctgaaagtgaagctggagaagctggcttctaccttgagagaagaagacgaatactctattcaccccccttcttctcactggaaacgattctacagagtcttcctggctgcctacccgtttgttaccatgacctgggaaggctggttccttacacaacaacttcggtacatattgggaaaagctgagcatcactctcccctgctgaaactggctggagttcggctaggtcgactgacagctcaggacatacaagctatggaacacagactggttgaagccagtgcaatgcaggagcccgtcagaagcattggtaagaagataaagtcagcactgaagaaagctgtgggaggtgttgccttatccctctctactggcctctctgtgggtgtattcttcctgcagtttcttgactggtggtactcttctgagaaccaagagaccatcaagtcactgactgccctgcccactccaccaccacctgtgcacctcgactacaactctgattctcccctcttacccaaaatgaaaacagtgtgcccactgtgtcgtaaagctcgggtcaatgatacggttcttgccacctctggctatgtattctgttaccgctgtgtgtttaattatgtgagaagtcaccaagcctgtcccattacagggtatccaacggaagtccagcatctaattaaactctactctccagagaactgaaagagagattagtgtattctctcacagctcaagttctatactataggaccacaagatggttttagtatggcaatcaacaatgattcataactacattaacttttagtagttatatggatttctttaaaaggatatatccacttggtcctaaccttatggtttgctctctaccaagctgtttaagcaggagaatcaggattgtaggtggtgtgagggcccatgtggaggtgggttataaaagaccacctcacttaagagtaaggttttaagttgtggtagtgtagtgtcagcactctggagatggaggcgggagtttgagttcaaggccaccaaagggggagtgtcaaaagtaaaatgaaagtaagagactgattaagagggataaaatagcataggaaaccccaggttagatcttacaaagcaagtggtttgggaagcaggccttctctttagaaaacatttctctacttttgaagtagaggctttatcagacacggactttctctttatagaaatatctataaaccctttagagaaaagccccctccatctatcatgacttactaacatctaccacagtttatcagtatttgaagatttccttcatgatccatacctgcctgtctagggaagggtttgtttatggggcggagtctggaaatttcaatatgaataaaaactagcaatggtgagatgcagtaaaatctttatctaatgtttacctgatgcctacctaatagatatctaatgagtaaaagctttctgcttgctcttatgagtttgctcagttgataggaatcatgctaggtattatgaaagtttctatgaaacatttaattaaattttaacaatacatgattctaggaaagaattgttccatgctgtcatgattatgtggaaactcaaaagatcacttcaggagtttaaataaatttttattcagatc

SEQ ID NO: 2452 - DNA, 1634 bp, Rattus norvegicus
  Genbank Accession No. NM_053950
cacagtcatggctgcggtggcggtggctgttcgcgaagaatcgagatccgagatgaagacagaactttcacctcggcccggggcagcggggcgggagttgacccaagaagagaagcttcagcttcggaaagaaaagaaacagcagaagaagaaacggaaggaggaaaagggggcagaccaagaaattggctctgctgtatctgcagctcaacgtcaagacccagtcagagaacttcaaggaactggtagtcagttgggaggcactactggggagaaacttccagctggccggagtaaggcagaacttcgagcagaaaggagagccaagcaggaggcagagcgggccctgaaacaggccagaaaaggggaacaaggaggaccctctcctcaggcctgccccagcacagctggagaagccacctcaggagtgaagcgtgtccctgagcacacccaggctgatgaccccacacttctgaggaggctccttagaaagccagatcgacaacaggttcctacaagaaaggattatggatccaaagtcagtctcttctcccacctaccccagtacagcagacaaagctccttaacccagtacatgagcatcccatcctctgtgatccacccagccatggtgcgactcggtctgcagtactcccagggccttgtcagtggctccaatgcccggtgcatagcgctgctccacgctctgcagcaggtgattcaggattacacaacacctcccaatgaggaactctccagggatcttgtaaataaactaaaaccctacatcagcttcctgacccagtgccgccccatgtcggccagcatgtgtaacgccatcaagttctttaacaaggaagtcactggtatgagcagctccaagcgggaagaagaggccaagtcagaacttaaagaagccatcgatcggtatgtgcaagagaagattgtgcttgcatctcaggcaatttcacgatttgcttctaagaagatcagtgatggggacgtgatcctagtatatggatgctcatctctggtgtcgagaattctccaggaggcctgggttgagggcaggcgcttccgggtggtggtggtagacagccggccccggctggagggaaggcatatgctccactgtctggtccgtgctggggtccctacctcctatctgctgattcctgcggcctcctatgtgctcccagaggtttctaaggtgctattgggagctcatgcactcctggccaatggatctgtgatgtcgagggtagggacagcacagttggccctggtggcccgagctcataatgttccagtactggtctgctgtgaaacatacaagttctgtgaacgcgtgcagaccgatgcctttgtctccaacgagctagatgaccctgacgatctccagtgtaagcggggagaccaggtgaccctggcgaactggcagaacaactcatcactccggttgttgaatctggtctatgacgtgactccccccgagcttgtggatctggtgatcacagagttgggcatgatcccttgcagttctgtgcctgttgtcctccgagtcaagagtagtgaccaatgaaaggcatcaagggtcaataaaaaacttattccttactgccataaaaaaaaaa

SEQ ID NO: 2453 - DNA, 4354 bp, Rattus norvegicus
  Genbank Accession No. NM_053951
caggcttctgcgccaggctgagctgacagactgagggcatgctaccagctacacgatgccgccctgccttcaccacagatgttactgctgcggagggcgaaagctcccgcctcacaccccacacaccccagggagccttcacatgccttggagattttcacccaaaattgtgatgtcatcaggagccattttttaatgtggatgaacacgggacctcagatgcttggactaacgtgacgtgggggtcctgaggctcgctctgaaggttcgatcagctgcccgtgcaccaaaagaagaggctgggccttgcagtgcagtagaatgtcagcgtgttccaggaggaggggcttctgctgatctgtggatcgatggcaaggaacaaacaacacagttttgcaagatgctggcatcgggttcatcttggtcatagaccgaagacaggacaaatggacttctgtgaaggcgtcagtcctgcgaatagccgcatcattcccagccaacctgcagctcgtcctcgttctccgacccacgggcttcttccagaggactctctcggacatagccttcaagttcaacagagatgagtttaagatgaaagtaccggtcatgatgctaagctcagtgccagaactacatggctacattgacaagtcacagctgaccgaggaccttggggggaccctggactactgccactccaggtggctgtgccaccgcacagcgattgaaagcttcgccctgatggtgaagcagacagcccagatgctgcaggcctttgggaccgagctggccgagactgagctgcccaacgacgtccagtcaaccagcctggtgctcagcgcacacacagagaagaaggctaaagtgaaggaggatctgcagctggcgctgacggaggggaacagcatccttgagagcctcagggagccgctggctgagagcatagtccacagtgtgaaccaggaccagctggacaatcaggccactgtgaagaggctcctgacccagctgaatgagaccgaggctgcctttgacgagttctgggcaaagcatcagcagaagctggaacagtgcctacagctgcgacattttgaacaaggtttccgggaggtcaaaaccgccttggattccatgtcccagaagatagccgcgttcacagatgttggcaacagcctggcccatgtgcagcacctcctgaaggacttgaccacctttgaggagaagtccagcgtggccgtgacaagccagagccctgtcctggaggggcagcagctgattgagaaccggcactatgctgtagactctatccatccgaagtgtgaggaactccagcacctctgtgaccacttcgcctctgaggtcaccaggaggcgggaccttctcagcaagtccttggagctgcatagcctcctggagacgtccatgaagtggagcgacgagggcatcttcctgctggcctctcagcctgtggacaaatgccaatctcaggatggtgcggaggcagccctgcaggagatcgagaagtttctggagaccggtgcagaaaacaagattcaggagctcaataagatttacaaggaatatgaatgcatcctcaaccaggaccttctggaacacgtgcaaaaagtctttcagaagcaagagagcaccgaggagatgttccaccgcaggcaggctagcctgaagaaactggcagccaagcagacacggcctgtgcagcccgtggccccccgaccagaggcgctaaccaagtccccctccccctcgccaggctcctggcgaagctctgagaactccagctctgagggcaacgccctccgcagagggccctacaggagagccaagagcgaaatgagtgagccccggcagggccgcaccagctccacaggagaagaggaggagagcctggccatcctgcgcagacacgtgatgaatgaacttctggacacggagcgggcctacgtggaggagctgctctgtgtcttagagggctatgctgcagagatggacaaccccttgatggcacacctcatctcaacaggcctgcaaaacaagaagaacattctgtttggaaacatggaggaaatctatcacttccacaacagaatattcctgcgggagctggagagctgcatcgactgcccagagctggtggggagatgctttctggagaggatggaggagttccagatctatgagaagtactgtcagaacaagccacgctccgagagcctgtggagacagtgctctgactgtcccttcttccaggagtgccagaagaagctggaccacaagctgagcctcgactcctacctgctgaagcctgtgcagaggataaccaagtaccagctgctgctcaaggaaatgctgaagtacagcaagcactgtgaaggggccgaggacctgcaagaggcactgagctccatcctgggcatcctcaaggcagtgaacgactccatgcacctcatagccatcactggctatgatggaaaccttggggacctggggaagctgctgatgcaaggctccttcagcgtgtggacggaccacaagaagggccacaccaaggtgaaggagctagccaggttcaagcccatgcagcggcacctcttccttcacgagaaggccgtcctcttctgcaagaagagggaggagaatggggaggggtacgagaaggctccttcctacagctacaagcagtccttgaatatgactgctgttggcatcacagagaatgtgaagggtgacaccaagaagttcgagatctggtacaacgcaagggaggaggtttacatcattcaggcaccaactcccgagattaaagcagcgtgggtgaatgagattcggaaggtgctgaccagccaactgcaggcctgccgggaagccagccagcaccgagccctggagcagtcccacagccttcccttgcccacgccagccagcaccagtcccacaaaagggagcacaagaaatgtcaagaagctcgaagatcggaagacggacccgctctgcctggaaggctgcgtgagctcatcattaccaaagccccccgagaagggcaaaggctggagcaaaacatcccactcactggaggcccctgaggaggacggaggctggtccagtgctgaggagctcatcaattcatccgatgctgaggaagacggaggagtgggccctaggaagctggttccaggtatgttcgggacctgaccagcagcaaggagggatgggtgccagccagcagcctagccaccctcctgggcaaatccagctcagcccagtgtctgagcagctcaggtaagacccactgtgcgcgccagctgtgccctgagcctgccaagatcctcagcccagagcctgtttaaaagcagaggggtttctaggtatgcagagaaaagggccagagccgaagcctgtctccactggtttcccgcagactccagcccagggtcagccgtgctgagcaactcatccagctgcagcgagggctaccctactcccttctccgagctccaggggtagtggccaggcctctgtggcaggcgctcaaggccaccgtgcagtagaccagcatgcaaatctctaagttttttctttttgcttgggcttgcttagtttgggaggggatggtgctccaagatatctggaaacaggaggacctatcaaccatgggcttcagaggacactggggccttggaaccaggactctgctgcatatgcagaaggcaggagacaacagttcaccaccaaagcttcttcagagactccagggtggacagaggcagggctatgggtcaggagaccttgcagaaagatgggagacggcccttttccacacatgcacagccagcagcccctgctatacagcctctccacggtgtcctggcctctctggtgctttctacgggaacatcatcctgaggaagccacttctaaccgggagtaaagagtttgctaccaacagcctaagaaggggatcaagggactcttgttcttttataagtttttgactttttttttaaaaaaacaaacaaacagggattaatcccatggccatttttctgtggtactctggcctcaaatcctaaaccaagaatcactgtgtttacatgaaatgacaatttgatactgtatttgatataaaactattttttgttactggggtttacatcaaagcacgttgtttatacaactgactgatttctggggcactctcactgagacctggcagcacaggtgctggaaggcctggtaagccaggtcctgtcctcctggtaagcccaggggctgtcctcttagccaggggggctgtctcctgttagccaggaggggcgtgtcctcctggtaagacagg

SEQ ID NO: 2454 - DNA, 4529 bp, Rattus norvegicus
  Genbank Accession No. NM_053961
aagcttcttgatttcacttttcttcagtcacaaacttgaggatggagctttaagagtatacacatggcctactattcggctatcacccaggcccagcttaggctctttttaaaaaaaagtcatttttttttaagatttatttattttatgtctatgagtacactgtagctgtcttcagacacaccagaagagggcatcagatctcattacagatggttgtgagccaccatgtggttgctgggaattgaactcaggacctctggaagagtagttgggtgctcttaaccgctgagccatctctccagccccccctttttttaaaaatatatttattgtatatatgtgagcacactgttaccatattcagacacaccagaagagggcatctgatcccttacagatggtcgtgagccaccatgtggatgctggggattgaactcaggacctctggaagagcaaccagtgttcttaaccactgaaccatctctccagtccatctgtatggctttcttttttttggttctttttttttttttcggagctggggaccaaacccagggccttgcgcttcctaggcaagcgctctaccactgagctaaatccccaaccccctgtatggctttcttaattgccagattttaacttcttctctcacctcctctaactactgcaatagatactcaactgcgctcagcctcagtcttctcccttctgatgcattctcttcattcattatccttttttatagtgagaaaaggttgctctataaagtccaggctgacctgagactaaattggccgtgctggcttcccattcacagagacccaccggcctcagctgagtgctggggtcaaaggctctagccatcatgcccagctgcaatgtcttttcttaaagggacatcaggcccgctggattggggcctgcctgtaggaggtcacttagctttaattatttctctaattactacaattatctctctaaatgcaattgtagtgcatctgaggcacgtgatttaatctgtgttatcccaaagtcctcttcaggtttcctcaggtctccagtgctctccttcccaggaaggcttggaactaaagccacatcatggtttttttgttttttttttctttttttcggagctgagctggggaccgaacccagggccttgcacttcctaggcaagcgctctaccactgagctaaatccccaaccccccacatcatgtttacgtgatgttttcatccacgaatctgagaaaacgctccacttaaagcctctggtggctgtaaaccccttgagactagtgagtctttatcttaccctcctgagtttgcctttacatagcttcatagagctcagcatgcttaaccatatcctgtttcccgttgcttcacaaatgttccctacctttcaaagtcatggctccccaactacctgggtacctcgatgacacgagtaagcaggactgactcgtaatacaggatcttcaaaggtggaaagccatgagatgggagtgaagattttaacacttaactgggtagatgggagccctggagaccacactcacaactcaaaaaggtaaggaggacatacaggtcttttttgggacatagccatgtgacactgtgacagaatgaccagtgtgtcatacttgcacagcctgtgtagaggtcaaggtcagtatggctggtcaaatggagggcagctagctgcctattagaggggcggtcattaggcgacaactgtaaaaagcacagctgaaggactgatcgctcctagggatggtggaggaggaattttattgtagataaaagggagagagcatagtcagagcaaagacggctgggagagtcagaggggcagcctgggttaagacactgacgaagagagtgccatagctaaaatggctggattatataaggaaaggcagctggacgaagggcagtccagaccttgggttggggaagtttagggtggggagcagggcatgcctgccataccctgaaggattctgggaaaacctcatggccaggtccactttgatgttagtcacctcagtttgtcccagggtttcagacttaacagtaataagaaagatagaaagtgcccgacataatccagctttggtttcatgattctacaggtgtgtgtgtgtgtgtgtgtgtgtgtgtgtgtgtgtgtgtgtgtgtgggtgtgtgtgtgcgtgcatatagaggtcactgattaagctcaatttggtgatcttcctcgcttccccagtactggcaagaattccacacccagctttttatgttttgtttttgtcattttgagacccaggttgactctgaagggcctagacctcactctgtagaccaggttggccttgaactcaggttcaccagccttggacttaggagtggtaagatgtgcttttcccttgggtgctgaggatgggacttatatgtgatgtgtacgagtcctggaacagggtatgtggatcagattttgatcagcctgccagttttccagtgagcactgggattgaaggcctgtgctgcctcacacagcctgctagctatgatccctgtgtcttctccagtgaggaattcattccttcgagcctttatcactgtgctgacttcccacgggaacaatcatcacgtggcatgagctactccctgaaaacggaacagcccagcctggtcttgtcaccctcctgccttgtgctgaaattaggcctgtaggcctgtgccacctactatacctgaccaaaagtagaatggcgaataggccttttcccaaccttctggggcaggggtggccccattgcctaagtgccccgcgggcctgtccagcgctgcaccctgtgacctacaagggcttggcagcgactaccagtgacaaacagctgactaaccgggggaagcgacgggtctcaacggacctcatgacagcccagcgcagagaaggcagggacgccgccacgtcttgttccaaggcgagagagggcaacgagggaattgttgaggctgcgcctcgcgcctctcctcacgcgagaacgccgcgaaacccagcctagacgagtggcacggagtgcgcgtgcgcgacagtcccacttcgcaggcccttccgtcacgtggccccagcccacctccccccacctcccccccaccgtgcccccgcttctctcactacacatgcgcagccgcccctctctgccccgcccctctgcggccggtctcttccaccctagaggccgcctgagcctctccgagtggccacgtgcgctcatgcgcgccggcgggacggccctcccagtgacgtgaccgcccactcggagcgctcctgctgtagcttgcccatctcccgctcccacaatccggcgtgatggctgccgccgttcctggcgccgtttcgctctccccactgctgtccgttctccttggcctgctgctcctctctgctcctcatggcgccagcggcctgcacacgaagggcgcccttcccttggacacagtcactttctacaaggtcattcccaaaagcaagttcgtcttggtgaagttcgacacccagtacccctatggagagaagcaagatgagtttaagcgtctggctgagaactcagcctccagcgatgatctcttggtggcagaggtggggatctcagactatggtgacaagctgaacatggagctgagtgagaagtacaagctggacaaagagagctacccagtcttctacctcttccgggatggggactttgagaatcctgtcccatacagcggggcagttaaagttggagccatccagcgctggctcaaggggcagggagtctatctgggcatgcctggatgtctgcctgcgtacgatgccctggcgggccagttcatcgaggcctccagcagagaggcccgccaggccatcctgaaacaggggcaggatggcctctcaggtgtgaaggagacagacaagaagtgggccagtcagtacctgaagatcatggggaagatcttggaccaaggtgaagacttcccggcctccgagctggcccggatcagtaagctcattgagaacaagatgagtgagggtaagaaggaagagctgcagaggagcctcaacatcctcaccgccttccgcaagaaaggcgccgagaaggaggagctgtgagggcaccaggctgctagggtttgctgagggcggggagggagagccgcctgctgactgtggggccctgtgggtggagggggcagtggagcaaagcagtcctgagccagagacctgtgccccgagtgcctggacactgaggctgctgagaccataccctggacatccttggagcagtttgtggggagcctgtgtgccaagacaagatggctgtgtcccacaggagctggtactatagaggaaggtccttgacaggtatagttctgatcaaataaaagtctgttttggttagatgattttcttctcagatagtactttttggcccctgtcaagagtctgagctgttgtgcattctattctgccaagacttgcctgcgtaa

SEQ ID NO: 2455 - DNA, 1632 bp, Rattus norvegicus
  Genbank Accession No. NM_053963
cggggttgatgaactggactctgttgctgaaaggagctggcacaatgaagtttctcctcgtgctggtgctgcttgtgtccttacaggtatctgcctgtggggctgctcccatgaacgagagcgaatttgctgaatggtacttgtcaagattttttgactatcaaggggacagaattccaatgacaaaaacaaaaaccaatagaaacctcctagaagaaaaactccaggaaatgcagcagttctttgggctagaagtaactgggcaactggacacctcaactctgaaaataatgcacacgtctcgatgtggagtgcctgatgtacagcatcttagagcagtgccccagaggtcaagatggatgaagcggtatctcacttacaggatctataattacactccagacatgaagcgtgcggatgtagactacatatttcagaaagcttttcaagtctggagcgatgtcactcctctaagattcagaaagattcataaaggcgaggctgacattacgatactttttgcatttggagatcatggagacttctacgattttgatggcaaaggtggtaccttagcccatgctttttatcctgggcccggtattcaaggagatgcacattttgatgaggcagaaacctggactaaaagttttcaaggcacaaacctgttccttgttgctgttcatgagcttggccattccttggggctgcggcattccaataatccaaaatcaataatgtaccctacctacagataccttcaccccaacacatttcgtctctctgctgatgacatacacagcattcagtccctctatggagccccagtgaaaaacccatccttgacaaatcctggaagtccaccatcaactgtgtgtcaccaaagcttgagttttgatgctgtcacaacagtgggagataaaatctttttctttaaagactggttcttctggtggaggctgcctgggagtccagccaccaacattacttcaatttcttccatgtggccaactatcccatctggtattcaagctgcttacgaaattggaggcagaaatcaactttttctttttaaagatgagaagtactggttaataaacaacttggtaccagagccacactatcccagaagcatacattctctgggcttccctgcatctgtaaagaagattgatgcagctgtctttgatccacttcgccaaaaggtctatttctttgtggataaacaatattggaggtacgatgtgaggcaggaactcatggacgctgcttaccccaagctgatttctacacacttcccaggaatcaggccaaaaattgatgcagttctctatttcaaaaggcactactacatcttccaaggagcctaccaattggaatatgaccccttactggatcgtgtcaccaaaacattgagcagtacgagctggttcggttgttaggaagaatgtagtgaaggatgcttgctggtttttgtttcataaacatttattacatatccactgtatgctcagggtgtaactacatggcaatgatgtaatgtgaaatgaggcgagatatacaagccacatacacatagttacacagaaaagtgcttttacaaaattaaagctcttttggtaaacttttccg

SEQ ID NO: 2456 - DNA, 1231 bp, Rattus norvegicus
  Genbank Accession No. NM_053965
acagcgacgaagatcaagactgccaggagctgcaagtagactgacagaagactgaccatggcagaggagccgaaacccatcagtccgcttaagaacctccttgccggcggctttggcggcgtgtgcctggtgtttgtggggcaccccttggacacggtcaaggtccgactgcagacacaaccaccaagtttgcctgggcagccacctatgtactctgggaccatcgactgtttccggaagactctttttagagagggcatcacagggctgtatcggggcatggctgcacccatcattggagtcacccctatgtttgcggtgtgcttctttgggtttggtttgggaaagagactacagcagaaatctccagaggatgaacttacctacccgcagctgtttacagctgggatgttatctggtgtgttcaccacaggaatcatgacccctggagaacggatcaaatgcttactgcagattcaggcttcttcagggaaaaacaaatacagtggtaccttggactgtgcaaagaagctgtatcaggagtttgggatccgtggcttctacaaagggactgcgctcactctcatgcgagatgttcctgccagtgggatgtatttcatgacatacgaatggcttaaaaatctcttcactccacagggaaagagtgtccatgacctcagtgtgcctcgggtcctggtggctggcggctttcgagggatcttcaattgggttgtggcaatccccccagacgtgctcaagtctcgattccagaccgcacctcctggaaaatatcctaatggtttcagagatgtgttgagagagctgatccgagaagaaggagtcacctccttgtacaaagggttcaatgcagtcatgatccgagccttcccagccaatgctgcctgtttccttggctttgaaattccgatgaagatcctcaattggattgcccccaacttgtgaggctgaagacatgttgaagacctttggatgctggaagactgttgccgagaagcaggggcaggactgggaagaccctgagggtgaggggagggaagtggtgtgatcagagccccaggcatgactgtgatggtgaaactgttgccttaatgacatcctctaccttatgtaacttggtgccattttgaaacttgaatatagaaggtttccagagaattggagatggaataaatagtttatagactcgtcaaaaaaaaaaaaaaaaaaaaaa

SEQ ID NO: 2457 - DNA, 1794 bp, Rattus norvegicus
  Genbank Accession No. NM_053969
gtttaacttgcagggggccgtggaacccatgcagattgatgtagatccgcaggaagatccccagaacgcacctgatgtcaactacgtggtggagaaccccaccctggatctggagcagtatgcagccagctacagtggtctgatgcgtattgagcggctacagtttattgctgaccgctgccctccgttgcgagtggaggccttgaaaatggctctgtccttcgtgcagaggaccttcaatgtggacatgtatgaagagatacaccggaagctctctgaggctaccagggagctgcagaatgcacctgatgccatccctgagagtggagtggagcccccacccctggacacagcctgggtggaggccactcggaagaaggccctgttgaaactggagaagttagacacggacttgaagaactacaagggcaattctatcaaggagagcatcaggcgcggccatgatgacctgggtgaccactacctggactgtggggacctcagcaatgccctcaagtgttattcgcgagcccgagactactgcaccagtgctaagcatgtcatcaacatgtgcctcaatgtcatcaaggtcagtgtctacttgcagaattggtctcatgtgttaagctatgtcagcaaggctgagtctactccagagattgctgagcagcggggagagcgggacagccagactcaagccatcctcaccaagctcaagtgtgctgcaggcttggctgagctggctgcacgaaagtataagcaagctgccaagtgcttccttctggcttcctttgatcactgtgatttcccagagctgctgtcccccagcaatgtggctgtctatggtggcctatgtgccttagccacctttgaccggcaggagctgcaacgcaatgtcatctccagcagctccttcaagttgttcctggagctggagccacaggtcagagacatcatcttcaaattttatgagtccaagtatgcctcatgcttgaagatgttggacgagatgaaggacaacctgctcctggacatgtacctggcccctcacgtcaggacactgtatacccagatccgtaaccgggctctcatccaatacttcagcccctatgtgtcagctgatatgcacaagatggctgctgccttcaacacaacagttgcagctctggaggatgagctcacacaggtcatcctggagggccttattaatgcccgcatcgactcacacagcaagatactgtatgctcgagacgtggatcagcgtagcaccacctttgagaagtccctgctgatgggcaaggagttccaacgacgggccaaagccatgattctgagagcagctgtgctacgcaaccagatccatgtcaagtctcctcctagagaagggagccaaggggagctgactccagcaaacagccagtcacggatgagcaccaacatgtgaaaggcattcccgtgaccttcagactagtctgcacagctcctctgccagtggaagcagcacctgggcctcctgcctgctttcctcaagatgagaccccagactgtgtggttcattagagcagtccagcccctgggatgccagttcattggccttccgcttcggaggccccctctgctgtggtaggcaggctgcccagtatggccattcgggcctgactctaggtttctgtcccaatgaaacagaccatgtgcaattcccaggtaagggttcctcaacccttcctgtccatgtagttctgactgcagcagtgtcactaaccaagtagtccattaaagtacagattgatcatt

SEQ ID NO: 2458 - DNA, 963 bp, Rattus norvegicus
  Genbank Accession No. NM_053971
ctctttcccgtcttgcaagatggcgggtgaaaaggcggagaagcctgataaaaaggagcagaaacctgcagccaagaaggctggcggtgatgctactgcgccccgcgccggggcctggtgcgtcaaaaagagtagttctaaggctaaaaagctgaggaagagtaagccccattgcagccggaaccctgtcctggtgagaggaatcggcaggtattcccgatctgctatgtattccagaaaggccttgtacaaaaggaaatactctgctgccaagacaaaggttgagaagaagaagaagaaagaaaaggtccttgctaccgtcacaaaaacagttggtggggacaagaacggtggcacccgggtggtgaagcttcgaaaaatgcctaggtattaccctactgaagacgtgcctcggaagctgctgagccacggcaagaagcccttcagccagcacgtgaggcggctgcgctccagcatcactcccgggactgtcctgatcatcctcactgggcgccacaggggcaagagagtggttttcctcaagcagctgggcagtggcttgctacttgtgactggacctcttgccctcaacagagttcctctgcgtaggacacaccagaagtttgtcatcgccacctctacgaaagttgatatcagcaaggttaaaattcccaaacacctgactgatgcttacttcaagaagaagccacttcgcaagcccaggcatcaggagggtgagatcttcgacacagagaaggagaaatacgaaattacagagcagcgaaaggctgatcagaaagctgtggactcgcagattttgccaaagatcaaagctgtcccccagctccagggctacctgcggtctcagttctccctgacgaacggcatgtaccctcacaaactggtgttctaattgttaacaacctaattaaactgcttcataaggaaaaaaaaaaaaaaaaa

SEQ ID NO: 2459 - DNA, 1601 bp, Rattus norvegicus
  Genbank Accession No. NM_053973
cgcatcactagtctgctctccctagctccgagctgctgtggccattgcctccagcgctgttttctgaggcctcgcctccgccgtctttcctgcccgagctccggtgcaaggcctccgctgccagacggtgcctggtgtcccgccgttcccatcctcggttggtccgccgttaggccgtgcctcaggcccaatccgcggcgacgccggcaggtgatgccaaatacagccatgaagaaaaaggtgctgttgatgggaaagagcgggtcggggaagaccagcatgaggtcgatcatctttgcaaattatattgcgcgcgacaccaggcgcctgggtgccaccatcgacgtggagcactcccacgtccgattcttggggaacctggtgctgaacctgtgggactgtggcggccaggacacctttatggaaaattacttcaccagccagcgggacaacatcttccgtaatgtggaggttctgatctacgtgtttgacgtagagagccgcgaactggaaaaagatatgcattattatcagtcgtgtctggaagccatcctccagaattcacctgatgccaaaatcttctgcctggtgcacaaaatggatctggttcaggaagatcaacgtgacctgatttttaaagagcgagaagaagacctgaggcgtttgtctcgcccgctggagtgcgcttgttttcgaacgtccatctgggatgagacgctctacaaagcctggtccagcatcgtctatcagctgatccccaacgttcagcagctggagatgaacctaaggaattttgcccagattattgaggctgatgaagttctgctgttcgagagagctacgttcttggtgatttcccactaccagtgcaaagagcagcgagatgtacaccgctttgagaagatcagcaacatcatcaagcagtttaagctaagctgtagtaaattggccgcttctttccagagcatggaagtgaggaattctaacttcgctgccttcatcgacatctttacatcaaacacgtatgtgatggtggtcatgtcagatccatccatcccttctgcagctactctgatcaacattcgtaatgccaggaaacactttgagaagctagagagagtagatggccccaagcatagcctcctcatgcgctgacataatgccaaatgctctttagtaaatgctgaattatggtgggtttttttttttgcatcatttgtttttaatattcataatgtcatgtgcttaaaagtgggctttgaaacgtgtgcttactatctcatctcttccctagtcttagtattggacgctatttactcagctatccagtagagatcctcaagacggcctttatgaaaagttagtgtggtgttaacactaaagtaggtggtgtgtatgggtgtgtgtgtgtgtgggtgtgttatggttacctggttataatagagtattaaagcagttatcttctgtattatcagatcacaaaggtggaatgttactattttatcagcaagatattaaaatgtatttctaaatcctccttggtttcaatcatgaataaacatttattattagcaatttaaaaaaaaaaaaaaaaaaaaaaa

SEQ ID NO: 2460 - DNA, 1483 bp, Rattus norvegicus
  Genbank Accession No. NM_053978
ccagcatcctcggacaccatgtcagactctgaggaggagagccaggaccggcaactgaaaatcgtcgtgctgggggacggcacctccgggaagacttccttagctacgtgttttgctcaagagacatttgggaaacagtacaagcagactataggactggatttctttttgagaaggattaccttaccaggaaatttgaatgttactcttcaagtttgggatataggagggcagacaataggtggcaagatgttggataaatacatctatggagcacagggaatcctcttggtatatgatattacaaactaccaaagctttgagaatttggaagattggtattctgtggtgaagacagtaagcgaagagtcagaaactcagcccctggttgctttagtaggcaataaaattgacttggagcatatgcgaacagtaaaacctgataaacacttacgattttgccaggaaaatggttttagtagccactttgtttcagccaagacgggagactctgtcttcctgtgttttcagaaagttgcggcagaaatcctgggaatcaagttaaacaaagcagaaatagaacagtcacagagagtggtgaaggcagatattgtaaactacaaccaggagcccatgtcaagaactgttaatccacctcggagctccatgtgtgcagttcagtgagcacacactgtattgatagttctggctgctcttccctggattgggcccaagctgcctaggaacatgttttatcagtgactgtctctgtagtcagctcacacttcctcctgctctgctccttcatcccttagtcgcctcagagtatcgggcagctccctggacaggaaggaattcagatttggaaccacatgttttgaaatctgaatggaaagtccattctctggattgagactgcctcctcgctccagaagaaccatgttgcttctttatctcttcttttttcccagatttaaaaaatttaaacagatatgaagatgctccacgctttgatcatcattttctatttgaacttgtatatgtgaacgtgtacttgagagcactgatggtggaagttatcaagaaggtgttcctttgctggctattaagagtaaactatacaaagctgcatctgattgaaagtgcttcaaatgaggctgcaatagaaatattttttcatttttaaaaggagcctaatgtgtttatattgtagtttataactcacaagtactgagtatttgatattgtatttttattactgtatcatggtcattgcatattttatcatatttggcttagatggctttatgaattttgataaatggttcagctgatcctccacatggaatttctcctacaggctgtatgagagtgcttccagatgagtcatgatatccttggatcattgtggatcgatcacactgtacctgatgttctgatgtttttctcacataaataaatttatttaaattaaaaaaaaaaa

SEQ ID NO: 2461 - DNA, 449 bp, Rattus norvegicus
  Genbank Accession No. NM_053982
accgtcaccatggtgcgaatgaatgttctggcagatgctctcaagagcatcaacaacgcggagaagaggggcaaacgccaggtcctcatcaggccgtgttccaaagtcatcgttcggttcctaactgtgatgatgaagcatggctacattggtgaattcgagatcattgatgatcacagagctgggaagattgttgtgaacctcacaggaaggttgaacaagtgtggagttataagccctagatttgatgttcaactcaaagacctagagaagtggcagaacaatctgctcccatcacggcagtttggtttcattgtgctgacgacctcggctggcatcatggaccatgaagaggcaagacgaaaacatacaggagggaaaatcctgggattctttttttaaatgtaaagcataaataaaaagcctctgtggactgtgaaaaaaaaaaa

SEQ ID NO: 2462 - DNA, 1107 bp, Rattus norvegicus
  Genbank Accession No. NM_053985
agcggtttggtcgttcgttggaggagcttcgtcttgttctgctctgcgattgcggcgcttgttcgagcgcttacagcggcgcgtcggtcccagcaagggcctcagacttcagctttgggtgagagaagatggcccgaaccaagcagaccgctaggaagtccaccggagggaaagccccccgcaaacagctggccaccaaggcggcccggaaaagcgcgccctctactggcggggtgaagaaacctcatcgctacaggcccgggaccgtggctctaagagagatccgtcgttaccagaaatcgactgagctgctcatccggaagctacccttccagaggttggtgagggagatcgcccaggatttcaaaaccgacttgaggtttcaaagtgcagccatcggtgcccttcaggaggctagcgaggcatacctggtggggttgtttgaagataccaatctgtgtgccatccacgccaagagagtcaccatcatgcccaaagacatccagttggctcgccggatacggggggagagagcttaagttgaagcgatttttatggcattttgtagtaaattctgtaaaatactttggtttaatttgtgactttttttgtaagaaattgtttataatatgttgcatttgtacttaagtcattccatctttcactcaggatgaatggaaagagtgactgttcacagacctcagtgatgtgagcactgtggctcaggagtgacaagttgctaatatgcagaagggatgggtgatacttcttgcttctcatgatgcatgtttctgtatgttaatgacttgttgggtagctattaaggtactagaattgataaatgtgtacagggtccttttgcaataaaactggttatgacttgatccaagtgtttaaccatacatcactgtgatagaatgtgggctttttcaaaggttgaagatacaagttttagccacagtgtaacagtttcctttaaaaaaaaaaaagtaaacctggcagctatagaatacactatgtgcatttataatagctattttatatattgtagtgttcaacatttttaaattaaatgttttacattcacaaaaaaaaaaaaaaaaaaaa

SEQ ID NO: 2463 - DNA, 3607 bp, Rattus norvegicus
  Genbank Accession No. NM_053986
gtcggctgagcggcgccggatccctggcaaaactgtggcacgaaccccgcatcgggtcggacccgcgttccccaggcgccggccagcgagcagcacgcgaggcgagcggcagagcggttgccgggcgagctggaaaccatggccaagaaggaggtaaaatcctcacttctggacaatatgatcggcgttggagatacggttctcttggagcctctcaacgaggagacgttcatcgacaacctgaagaagcgcttcgatcacaatgagatatatacatacatcgggagtgtggttatatctgttaacccctaccggtccttgcccatttattcaccagagaaagtggaagattacagaaatagaaacttctatgaactgagccctcacatctttgctttgtcggatgaagcatacagatccctccgtgatcaagataaagatcagtgcattctcattactggggagagtggagcgggaaaaacagaggccagcaagcttgtgatgtcctatgtcgctgcagtgtgtggaaaaggagcagaagttaatcaggtcaaggaacagcttctccagtccacccctgtcctggaagcttttggaaatgccaagactgtaaggaatgacaattcatccagattcggcaaatacatggatattgaatttgactttaaaggcgatccgctgggaggagtgataagtaactatcttttagagaaatctcgtgttgttaagcagccgagaggtgaaagaaacttccacgtgttctatcagctgctctcgggtgcctctgaggaactcctccacaagcttaaactggagcgggatttcagcagatacaactatctgagtctggactctgccaaagtgaatggtgtggacgacgctgccaatttcagaactgtcaggaatgccatgcagatcgtgggcttttcggatcctgaggccgagtctgtcctggaggttgtggcagctgtcttgaaactggggaacatcgagttcaagcctgaatcacgaatgaacggtttggatgaaagcaaaatcaaagacaaaaatgagttaaaagaaatttgtgagttgaccagcatcgatcaagtggttttagaaagagcgttcagtttccgaacggttgaggcgaagcaggagaaagtttcaaccacattgaatgtggctcaggcttattatgcccgtgatgccctggctaaaaacctctacagccggttgttttcatggttggtaaatcgaatcaacgaaagcattaaggcacaaaccaaagtgagaaagaaggtcatgggtgttctggacatttatggctttgagatatttgaggacaacagcttcgagcagttcattattaattattgtaatgaaaagcttcaacaaatcttcattgaactgaccctcaaagaagagcaagaggaatatattcgtgaggacatagaatggactcacattgactacttcaacaatgctatcatttgcgacctaatagaaaacaacacaaacggaatcttggccatgctggatgaagagtgcctgagacccggcactgttacagatgagaccttcctggaaaagctgaaccaagtctgtgccacccaccagcacttcgagagcaggatgagcaaatgttcccgcttcctcaatgacacgaccctgcctcacagctgcttcagaatccagcattatgctggcaaggtgctataccaggtggaagggtttgttgacaagaacaatgaccttctgtaccgagacctgtctcaagccatgtggaaggctggccatgccctcatcaagtctctgttccctgaagggaatcctgcaaaggtcaacctgaaaagacctcctactgcagggtcccagttcaaggcgtcggtggccaccctgatgaaaaacctgcagaccaagaacccgaactatatcaggtgcatcaagccgaacgataaaaaggccgctcacattttcagtgagagtctcgtgtgccatcagatccggtacctgggtcttctggagaacgttcgagtgagacgggcaggctatgccttcaggcaggcctatgaaccttgtctggaaagatacaagatgctttgcaaacaaacatggcctcactggaagggaccagcaaggtctggtgtggaagttctgtttaatgagctagagattcccgtggaagagtactccttcggtagatccaagatattcatccgaaacccaaggacattattccaattagaagacctaaggaagcagcggctggaggacctggccactctcattcagaagatttatcgaggatggaaatgtcgtacacattttctgctcatgaaaagaagccaagtcgtgattgccgcctggtacaggagatacgcgcaacaaaagcgatatcagcagataaagagttcagccctggtgattcagtcttacatccggggctggaaggctagaaaaatcctgcgggagctgaagcatcagaaacgctgcaaggaggcagccaccaccatcgcagcatactggcacggcacccaggcgcgaaaggagcggaggcggctgaaggacgaggctaggaataagcacgctattgcagttatttgggctttctggcttggatcgaaggcacgaagggaattgaaacgcttgaaggaggaggctaggcgtaagcatgcagttgctgtcatttgggcttactggcttggactgaaggtacgaagggagtacaggaaattctttagagcaaatgctggaaagaaaatctatgagtttacacttcaaagaattgtgcaaaaatacttgttggaaatgaaaaataaaatgccttccttgtcaccaatagataaaaattggccatcaagaccttacctattcttggattcgactcacaaggagctaaaaaggatcttccacttgtggaggtgtaaaaaatacagggatcaattcacagaccagcagaaacttatttatgaagagaagctggaggccagtgaactcttcaaagacaagaaggctttatatccttctagtgttggtcagccattccaaggagcttacctggaaatcaacaagaacccaaaatataagaaactcaaagatgccattgaagagaagatcattattgctgaggttgtgaacaaaatcaaccgggctaatgggaagagtacatctcggattttcctcttaacaaacaataaccttctccttgctgaccaaaagtcggggcagatcaagtccgaggtccccctggtggatgtgactaaggtctccatgagttcacagaatgatggtttctttgcagtacacctcaaggagggttcagaagcagctagtaagggtgactttctcttcagcagtgaccacctgattgaaatggcaaccaagttgtatcgcacgactcttagccaaactaaacagaagctcaatatcgagatttccgatgagttcctggtacagttcagacaggacaaagtatgtgtgaagtttattcaaggcaaccagaaaaacgggagcgtgccaacctgcaaacgaaagaacaacaggcttcttgaagtcgctgtcccttaagtgaggcctcctctctgttctcacggacttgtttcctcgtaacagtgcaattttactt

SEQ ID NO: 2464 - DNA, 3180 bp, Rattus norvegicus
  Genbank Accession No. NM_053989
agctagaagagagaggatgactgcacgagaagaggccagtttaagaacacttgaaggcagacgacgtgccacattgctgagtgcccggcaggaatgatgtctgctcgaggagattttctcaattatgccctgtctttaatgagatctcataatgatgagcattctgacgttcttccagtgttggatgtgtgctcattgaaacatgtggcatatgtttttcaagcccttatatattggattaaagcaatgaatcaacagacaactttagacacccctcaactggagcgcaaaaggacacgagaacttctggaactgggtattgataatgaagattcagaacacgagaatgatgatgacaccagtcaaagcgctactttgaatgataaggatgatgaatctcttcctgcagaaaccggccaaaaccatccatttttccgacgttcagattctatgacattccttggatgtatacctccaaatccatttgaagtgcctttggctgaagccatacccctggctgatcagcctcatctgttgcagccaaatgctagaaaggaagatctctttggtcgcccaagtcagggtctttattcgtcatctgccggtagcgggaaatgcttagtggaagttacaatggacagaaattgtctcgaggttcttccaactaaaatgtcttatgctgccaatctaaaaaatgtaatgaacatgcaaaaccggcagaagaaagcaggggaagaccagagcatgctggccgaagaggctgacagttcaaagccagggccatccgctcacgatgttgccgcccagttgaaaagcagtttactagcagagataggactcacagaaagcgaagggcctccccttacatctttcaggccccagtgcagtttcatggggatggtgatctctcatgacatgctgctggggcgctggcgcctctctttagaactgtttggcagagtattcatggaagatgttggagcggagcctggatcgatcttaactgaattgggtggttttgaggtaaaagaatcaaagttccgtagagagatggaaaaactgagaaaccagcaatcaagagatttatcactagaggttgatcgagatcgagatcttctcattcagcagactatgagacaactcaacaatcattttggtcgaagatgtgctaccacaccaatggctgtccacagagttaaagtcacatttaaggatgaaccaggagagggcagtggtgtagcacggagtttctatacagccattgcacaagcctttttatcaaatgaaaaattgccaaatctagattgtatccaaaatgccaacaaaggtactcatacaagtttaatgcaaagattgaggaacagaggcgagagagatcgggaaagagaaagagaacgggaaatgaggaggagcagtggcttgcgagcaggatctcggagagaccgcgatcgagacttcaggagacagctgtccatcgacaccaggccttttagacctgcttctgaggggaaccctagtgatgaccctgaccctcttccagctcatcggcaggcactcggagagaggctgtacccccgagtgcaagcgatgcagcctgcctttgccagtaaaatcaccggcatgctgctggagctgtccccagctcagctgcttctccttctggcgagtgaggactctctgagggcgagagttgaggaggccatggagctcatcgtcgcccacggacgggaaaatggagctgacagtatcttggacctcggattattagactcctcagaaaaggtacaggaaaaccgaaagcgtcatggctctagcagaagtgtggtagatatggatttagatgacaccgatgatggtgacgacaatgctcctttgttttaccaacctggaaagcgagggttttatactccgagacctggcaaaaacacagaagcaaggctgaattgtttcagaaacatcggcaggattcttggactatgtctgttgcaaaatgaactatgtcctatcacattgaataggcatgtaattaaagtgttgcttggtagaaaagtcaactggcatgactttgcttttttcgaccctgtgatgtatgagagtttacgacaactgatccttgcatctcagagttcagatgccgatgctgttttctcagcaatggacttggcgtttgcagttgacctgtgtaaagaagagggtggaggccaggttgaacttattccaaatggtgtaaatataccagtcactccgcagaatgtatatgagtatgtaaggaaatatgcggagcacagaatgctggtggttgcagaacagccattgcacgcaatgagaaagggtctactagatgtgcttccaaaaaattctttagaagacttaacagcagaggatttccgacttttggtgaacggctgtggtgaagtcaatgtgcagatgctcatcagtttcacgtctttcaatgatgagtcaggagagaatgctgagaagctcctgcagttcaaacgttggttctggtcaatagtagagagaatgagcatgactgagcggcaggacctggtttacttctggacatcaagcccatcattgccagccagtgaagaaggttttcagcctatgccctcaatcacaataagaccaccagatgaccaacatcttcctactgcaaatacttgtatttctcgactttatgtcccactctattcctctaaacagattctcaaacaaaaattactactcgccattaagaccaagaattttggttttgtgtagagtataaaaagtgtgtattgctgtgtaatattactagctaattttgtagattttttttcccatttgtctataaaagtttatggaagttaatgctgtcatacccccctggtggtaccttacagagattaaatgcaaacattccttgctgagtttgtagcttaaaggcctaagaagcactggcaccttttctctatgatggtttgctagtcgccaacttctaggtctaaccccagccaaagatgacagcagaacaacataatttacactgtgatttatcttttttgctgagggggaaaaaatgtaaaatgttctgaaaattcactgctgcctttgtggaaagtgtttcagcaaaggttcttgtatagagggaatagggaatttcaaaataaaaaattaagtatgaaaaaaaaaaaaaaa

SEQ ID NO: 2465 - DNA, 1420 bp, Rattus norvegicus
  Genbank Accession No. NM_053995
ccctcaatagccacactatttattttatttcaattaaaaatttcttcccaaacctttcctgcacctccctcacccaaaactataaactcggtgccatgatgctggccgcccgtctttccagacccctgtcacagctcccaggaaaagctctaagtgtctgtgatagagaaaatgggacaagacacacactgttgttttacccagcttctttcagccctgacacccgtcggacctacaccagccaggcagatgcggctagtggcaaagctgtcctggttacaggctgtgactctggatttgggttctctttggccaagcatctacactcaaaaggtttccttgtatttgccggatgtttgttgaaggaacaaggcgatgctggggtcagggagctggacagcctgaagagtgaccggctgagaaccatccagctcaatgtctgcaacagtgaggaggtggagaaagcggtggagaccgtccgctccggcctgaaggatcctgagaagggaatgtggggcctggttaacaacgcaggcatctcaacgtttggggaggtggagttcactagcatggagacgtataaggaggtggccgaagtgaacctctggggaactgtgcgcacaacaaaatccttccttccccttctccgaagagccaaaggccgtgttgttaacatcagcagcatgctgggtcgcatggccaacccagcccgctcaccatactgcatcaccaagtttggggtagaggctttctcggactgcctacgctatgagatgcaccctctgggtgtgaaggtcagtgtggtggagcctggcaacttcatagctgccaccagcctctatagccctgagcgtatccaggccattgccaagaagatgtgggatgagctgccagaggtcgtccgcaaagactatggcaagaagtacttcgatgaaaagattgccaagatggagacctactgcaacagcggttccaccgatacgtcctccgtcatcaacgctgtcacccatgccctgactgctgccaccccttatacccgctaccatcccatggactactactggtggctgcggatgcaggtcatgacccattttcctggagccatctctgacaagatctacatacactgaagagctgaagaggtccctgcagcctctgccagggagcctgatgggagggagttcatacagttatcttttgattaaccattgtgggttgtccactgtcttaggaagacctattttaaccttacgtgttcaatgtggtgaatggtttgggccttcacaaatacagggcactggtgggtggccctaaccctcaaggccaatatggtgcttctatctgtctatctagagttgattttatataaagatttgtgggaaatacctttatattaaagacgttattagaatagaaaaaa

SEQ ID NO: 2466 - DNA, 2142 bp, Rattus norvegicus
  Genbank Accession No. NM_053999
ggggccgccgtcgctgtcctagccgccgccgctgccgccgccgccgctgccgtcttcaccgcgggagaaggagcacgagacaggacgcccctgagtgaacgccaccatcctgccgacagctccgcccgggctgcttcctttccgcccaggtccccgtcccctcccccctcaggtgccatccgcctccatccgcgccctcgatccccccatccccaggtgagggggctgagccccggtcgcggaggcccggacgagcccggcagggtcaccatttgcagcgcgacatggcaggagctggaggagggaatgatattcaatggtgtttttctcaggtgaaaggagcagttgatgatgacgtagcagaagcagatataatttctacagtagagtttaatcattctggagaattactagccacaggagataaaggtgggagagtcgtcatctttcaacaagagcaggagaacaaaatccagtctcatagcagaggagaatacaatgtttacagcaccttccagagccatgagccagaatttgactacttgaaaagcttagaaatagaagagaagatcaacaaaattaggtggttaccccagaaaaatgctgcccagtttttattgtctaccaatgataaaacaataaaattatggaaaatcagtgaaagagacaaaagaccagaaggctataacttgaaagaggaagatggaaggtatagagaccctactacagtcactacactacgagtgccggtgtttaggcccatggatctaatggtggaggccagtccgcggagaatatttgccaacgcccatacctaccacatcaactccatttctatcaatagtgattatgaaacctacttatcagcagatgatttgcgaattaatctctggcatctggaaattacagacaggagttttaatattgtggacattaagcctgccaatatggaggagctcacggaggtgatcacagccgcagagttccatcccaacagctgtaacacgtttgtgtacagcagcagtaaagggaccattcgcttatgtgacatgagggcatctgcactctgtgacaggcattctaaactgtttgaagaacccgaagatcccagcaacaggtcgtttttttctgaaatcatctcctcaatttctgatgtaaaattcagccacagtggtcgctatatgatgactagagactatttgtcagtcaaagtttgggacttgaatatggaaaacaggcccgtggagacataccaggtacacgaatacctcagaagtaaactttgctcactgtatgaaaacgactgcatatttgacaaatttgaatgttgttggaatgggtctgacagtgttgtcatgactggatcctacaataatttcttcagaatgttcgacaggaacacaaagcgggatataactctagaagcatcgcgagaaaacaataagcctcgtacagttttgaaaccacgcaaagtctgtgcaagtggcaagcgaaagaaagatgaaataagtgttgacagtctagacttcaacaagaaaatccttcatacagcctggcatcccaaggaaaacatcattgctgtagcgactacaaacaatctgtatatatttcaagacaaagtgaattaggctggcattctctgcagaggagccacttcctgcttagtgagatagttgaatctagcattcgtacctataagagagcggtccattgtggcgtccctttccagtgtttgacagtgtgccattcaacaacacatttgatagccacatggagaaagctgtgcggatgcatcccgggctgtttccatgtctgctagccatttagggaagggaagggcacttttaatttaatgacttcttgcaccatcttgcctggtggactggactggactgtgtcagcattgatgtactccactttttatgccttccattgtgatgacgtcaaacacagtgaacgccttcagtcatgctatggaatttgtgtatcctcattactgtatcatttgtgggagtgcaagggtaatcatttattgaactgcaagagcaagatatttgtgcggaatgatcatgggtggggccaagagaaatttaagaaagcttttaattctcgatgtgttgtcctgggtaactagggaagatg

SEQ ID NO: 2467 - DNA, 1938 bp, Rattus norvegicus
  Genbank Accession No. NM_054001
ggccaggcgatcccagcacccgcgatcgcgcgctctgtgctccgagggccgtgctcgcctggtgcctactccagggctgtgtacaccgcgtcgggctcggctgagcccgcaccaggagggcgcgggagccgcagggccctggagctttgggcgactgctacgcggccttggccgaggctcttccttgctcgccgttctgtcgcgggcctggcccgtgaaccgctcacagtatggcccgatgctgcttctacacggcggggacactgtctctgctgctgctggtgaccagtgtcacgctgctagtggctcgagtctttcagaaggcagtggaccagacgatcgagaagaatatggtattacaaaatggtaccaaggtctttgattcctgggagaagccccctctacctgtgtacatccagttttatttcttcaatgtcaccaatccagaggagatcctccaaggagaaatccccctgctagaagaagtggggccgtacacctacagggagctcaggaacaaggcaaacgttcagtttggagaaaatggaacaaccatatctgccgtcaccaataaggcatatatttttgaacgaaaccagtctgttggagaccctaccgttgacttgattagaacaataaatattcctctgttgactgttgtggaaatggcccagcagcccttcctcagggagatcatcgaggccatgctgaaagcttatcagcagacgctgtttgtcactcacactgtacatgaactgctctggggctacaaagatgaggtcttgtcgctcgtccatattttcagacctgacgtctcccctaactttggcctgttctatgagagaaatggaactaatgatggggagtatgtttttctgactggagaggacaattacctgaactttacaaaaattgtggagtggaatggaaaaacgtcgctggactggtggacgacggacacgtgcaatatgatcaacgggacagacggagattcttttcacccattaataagcaaggatgagaccctgtacatcttcccatctgacttctgcaggtccgtctatataactttcagtagctttgagaacgtagaaggactgcctgcttttcggtataaggtgcctgcagaaatactagccaattcctccgaaaacgctggcttctgtatacccgagggaaactgcatggacgcgggagtgctgaacgtcagcatttgcaagaatggtgcgcccattatcatgtctttcccacacttttaccaagccgacgagaagttcgtttcggccataaaaggcatgcgtccaaacaaggaagaacatgagtcatttgtggacattaatcctttgacaggaattattttaagaggggccaagagattccaaatcaacacgtacgttaagaagctggatgactttgtggaaacgggaaacattaggactatggttttcccagtgatgtatctcaatgagagtgttctcattgacaaagagactgcaagtcaactgaagtctgtgattaacacaactttgattgtcaccaacataccctacatcatcatggcactgggcgtgttctttggcttgattttcacgtggctggcgtgtcgaggacaggggtctacggatgagggaactgcagatgaaagggcacccctcatacggacctaatgggacttacctgttgcctgagcttggtgagagaatgtgagaactgacctgacctggaccaggacagggaaaagcctgcatctcacgggctcctggcctgtcaagaagggagatgaagccgcagcactggcacgcgagaagaccctcctggacagaggggaccgagcaggtgacatggctggcaattacgctttataaaatcatgtctctgaaactgtgtcaatgtgtcttagggagtatttaataaattatatagaaacctttaaaaacc

SEQ ID NO: 2468 - DNA, 4383 bp, Rattus norvegicus
  Genbank Accession No. NM_054004
tctggcctcttgccctaagaagcgagtgcggagggagtgggagcgagactgcccgaacgcaagtgtctggcttcccggcgaggcccaggcgtccgtcccgccgcccatgaactcgttgccccgcgagcagcgccgtcgttaggccgtccccgtcactctcgctcgcccccatccccgggcagccattcccccctacccacgtctggccggggactggacgtcgtgtcgaagcgccttccccagtccgcgtcgcgctgcgaccctggaagcgggcgccgccgccaacgagaggaggagccccggccgcggggcccagcagccactgagccagcaggcgggatcgaggccggcaacatggcgagcgcttcgtaccacatctccaacttgctggaaaaaatgacatccagcgacaaggacttcaggtttatggctacaaatgatctgatgacagaactgcagaaagactccatcaagctggatgatgacagcgaaaggaaagtcgtaaagatgattctgaagttgctggaggataaaaatggcgaagtgcagaacttagctgtgaaatgtcttggtcctttagtgagtaaagtgaaagagtaccaagttgagacgattgtagacaccctctgtacaaacatgctttctgacaaggagcagcttcgagatatttccagtattggccttaaaacagtaattggagaactccctccagcttccagtggctctgcattagctgctaatgtatgtaaaaagattactggacgccttaccagtgcaatagcaaagcaggaagatgtttctgttcagctagaagctttagatattatggctgatatgttgagcaggcaaggaggactgcttgttaatttccatccttcaattctgacctgtctacttccccagctgactagccctagacttgcagtcaggaaaagaacaattattgctcttggccacctagttatgagctgcggaaacatagtttttgtagaccttattgaacatctgttgtcagagttgtccaaaaatgactccatgtcaacaacaaggacctacatacagtgtattgctgctattagtaggcaagctggccatagaataggtgaataccttgaaaagataattcctttggtggtaaaattttgtaatgtagatgatgatgaattaagagaatactgcattcaagcttttgaatcatttgtgagaagatgccctaaggaagtttatcctcatgtttctaccattataaacatttgtctaaaataccttacctatgatccaaattacaactatgatgatgaagatgaagatgagaatgctatggatgctgatggcggagatgacgatgaccaagggagtgacgatgaatacagtgatgacgatgacatgagttggaaagtgaggcgtgcggctgccaagtgcctggatgccgtagttagcacacggcatgagatgctcccggaattctacaagaccgtctctcctgcactgatatccagatttaaagagcgcgaagagaatgtaaaggcagatgtttttcatgcatacctttctcttttgaagcaaactcgtccagtacaaagttggctgtgcgaccctgatgcaatggagcaaggagaaacacccttaacaatgcttcagagtcaggttcccaacattgttaaagccctacataaacagatgaaagaaaaaagtgtaaagacccgacagtgttgttttaacatgttaactgaactggtaaatgtgttgcctggggcactaacccaacacattcctgtacttgtaccaggaatcattttctcactcaatgataagtccagctcatcgaatctgaagattgatgcattgtcctgtctgtatgtgatcctctgtaaccactctccgcaagttttccacccgcatgttcaggctttggtccctccagtggtggcttgtgttggtgacccattttacaagatcacatcagaagcccttcttgtcactcagcagcttgtcaaagtaatccgtcctctggaccaaccctcctccttcgatgcaacgccttacatcaaagatctcttcacttgtacaattaagcgcttaaaagcagctgacattgatcaggaagtcaaggagagggctatttcctgtatgggacagattatttgcaatcttggagacaatttgggccctgacttatcaaatacacttcagattttcttggagagactcaagaatgaaatcacccggctaacgacagtgaaagcactgaccctgattgctgggtcacctttgaagatagatctgaggcctgtgctgggagagggagtccctatccttgcttcatttctcaggaaaaatcagagagctttgaaactggggaccctctctgccctagatattctcattaaaaactatagtgacagtttgacggccgccatgattgatgcagttctggatgagctccctcctcttatcagcgaaagtgatatgcacgtgtcccagatggctatcagcttccttactaccctggcaaaagtatatccctcctccctttcaaagataagcggatctattctcaatgaactgattggacttgtaaggtcacctctgctgcagggaggagctcttagtgccatgctagacttcttccaagctttggttgtcactggaacaaacaatctaggatacatggatttgctgcgcatgctaacgggtccagtttactctcagagcacagctcttactcataagcagtcttactattccattgccaaatgtgtagctgcccttactcgagcatgccctaaagagggaccggctgtagtaggtcagtttattcaagatgtcaagaactccaggtctacagattccattcgtctcttagcgctcctttctctaggagaagttggacaccatattgacttaagtgggcagttggagctaaaatctgtaatattagaggctttctcctctcctagtgaagaagttaaatcagctgcatcctatgcgttaggcagcatcagtgtaggcaacctccctgagtatctgccatttgtactacaagaaataaccagtcagcccaaaaggcagtacctgctgctgcattccctgaaggaaatcattagctctgcgtcagtggtcggccttaagccgtatgtcgagaacatctgggccttgctgctaaagcactgtgagtgcgcggaggagggcaccagaaacgtcgtcgccgagtgtctagggaagctcactcttattgatcctgaaactctcctcccgaggcttaaagggtatttgatatcagggtcatcctatgccagaagctcagtggttacagctgtgaagttcactatttctgaccaccctcagcccattgatccactgctcaagaactgcataggtgattttctaaaaacgttggaagacccagatttgaatgtaagaagagtggccttggtcacattcaattctgcagcccataacaagccgtcactgatacgggaccttctggattctgttcttccacatctttacaatgagacaaaagttaggaaggaacttataagagaggtagagatgggcccgtttaagcacacggttgatgacggcctggacattagaaaggcagcttttgagtgtatgtacacacttctagacagctgtcttgacagactggatatctttgaatttctaaatcatgtggaagatggtttgaaggaccattatgatattaagatgctaacatttttaatgttggtgagactatctaccctttgtccaagtgcagtactacagaggttggaccggcttgttgagccactacgagctacgtgtacaactaaggtgaaggcgaactctgtaaagcaggagtttgaaaagcaggacgagttaaagcgctcggccatgagggcagtagctgcactgctcaccattccagaggcagagaagagccctctcatgagtgagttccagtcacagatcagctccaacccggagctggcagccatctttgaaagtatccagaaagattcttcgtccactaacttggaatcaatggacactagttagacgtgtgttccacatgaggaccattacatttgaccgcacagtgcactgaaccgacaagttgaccatagacacgggagagaagtgtctagagcttcaggatgttccacttttattttcattcatgggaagtttgttcagctttcttccattgttgtttttgtagcttttacttcagaaatctgtatttccataatccagaggttgtaagaccactgatggttttagtggttagggcaacgtttgaaatgggaactaaagtttggatttatggaatgtggaaatagggtccagtatctgtttgccctgtaatgtgtaggattaaaatgttaaaacttt

SEQ ID NO: 2469 - DNA, 2282 bp, Rattus norvegicus
  Genbank Accession No. NM_054005
gtgataggagctctatgtagctgctgagctctgtgcagaattgggctggctggcccatagccctttgaggagcgacctggaaggtgagtgctgtaccaggaactgctggccaggatacagctccacagctgtggagctctcaccagcaccacccttggtgtggccaaaccgacacgtttccctagacaccaggaagccgacaaaactcagaaaactataaaaagcctgagggctctgaggcaccctgccaagatggaggtcactggaaggctgttcatttgggccattttagctgtctcctgtagggcacagctcaattctacagcagctgaaggcagaccaagatgcacggccagtctgggaggggccaatctgggagagacccacaaggctctgatcctaaatctcaatgctgatgagaactgcacttggaccatagagagacctgaaaacaggagcatcagaatcatcttctcccacatccagttggatccagacagtcggtgtgaaaatgaaagcattaaggtgtttgatggacgctccaccagtgggcctctgctaggggaggcctgcagcaaaaatgacttcgtgcctgtgtttgagtcatcggccaattcactgacgtttcagatagtcactgactggacaagggttcaaaggagtgtctttatcttctactatttcttttcctctggtaccactattccaaactgcggtggttacctgcaaacattggaaggatccttcagcagccccaattatccaaggccacaccctgagctggcatactgtgtgtggcacatacaagtggagaaaggctataagataaacttgaattttacagagctcttcctagaaatggatgaatactgccgatttgacttcatcgcagtctacgatggcccctctaccacatcgggcttgctcaaacaggtgtgcggccgtgggacacctacctttgagtcttcctctgatgccatgactgttgtgctgtctacagattatgccaattcctacagaggcttctttgcttcctacgcttcaacctacgtacaagaggtcaacactcactctttaagttgtgcttctgacaagatgagagtcatcatcagcaagtcatacctacagtcacttaactaccatgagagcaatttgcagctaaacgacccgacttgcagaccgagtgtatcaaacgttgtagagttctctatccctctgcatgaatgcggtacaatcaaaaagatagaggaccacactatcagttatacgaacataatcaccttcacccagtctccagaatctgccgtgatcacccgaaagaggcaccttcagattgtggtgacgtgtgagatggagtataattcaactgtggagattctgtacataaccgaagacgacgtcatacaaaatcaaagtgtcctgggcaaatacaacaccagcatggctctttatgagtccggctcctttgaaaaccttatacaggagtcaccgtattatgtagatttgaaccaaaccctttttgtccaagccactttgcacacctcagatccaagcctggtggtgtttctggacacttgcagagcctctcccacatccgactttgcatctccaacctatgacttaatcagcagcgggtgtagtcgagatgagacctgtgaggtgtaccccttatttgggcactacgggagattccagttcaatgcctttaaattcttgagacatctgagttctgtgtatctcaagtgtaagattttgatctgtgataccagtgaccacacatctcgctgcaatcaaggctgcgtctcaagaaggaaacgagatattccttcatacaaatggaagactgattctgttataggaccaattcgcctgaagagggaccgacttgtaaatggagattcaggacttctgcctcaaacacacgaagcagagatttcgaagcagcctctcagccatctgcacctgttttccttcatggttcttgctctgaatgtggtgattgtggtcacagccacagtgaggcattttctaaatcgatggaaggatcacggataccagaagctgcaggtctactagctgtggaccccaagaaaggcctcttgtcctcttctgggtggccgatgaaaaagttctctgtgcctacgagggttagggctttccccgaaaggcctaaaagcagcgtgtgtaccgtcatgctcgtatcacagcctcagtgtgtttcattatgggatagctgaaatgaataaatagtatgtctggtcaaaaaaaaaaaaaaaaaaaaa

SEQ ID NO: 2470 - DNA, 3755 bp, Rattus norvegicus
  Genbank Accession No. NM_054006
gaattccttttttttttaatactagcaactttcattctttggaacttgtgctgaaaaaaagaagagtcagcaaatactactgaaagtgcaatattcgattatcactgcgagatgagctttgatccaaaccttctccacaacaatggacacaacgggtaccccaatggtacttctgcagcactccgtgaaactggggttattgaaaaactgctgacctcttatggatttattcagtgttcagaacggcaagctaggcttttcttccactgttcacagtataatggcaacctccaggacttaaaagtaggagatgatgtggaatttgaagtatcatctgaccggaggactgggaaacctattgctattaaattggtgaagataaaaccagaaatacatcctgaagaacgaatgaatggacaagttgtgtgcgctgttcctcacaacttagagagtaaatctccagctgccccgggtcagagtccaacagggagtgtatgctacgaacgtaatggggaagtattttatctgacttacacctctgaagatgtggaagggaacgttcagctggaaactggagacaaaattaactttgtaattgataacaataaacacactggtgctgtaagtgctcgtaacattatgctgttgaaaaagaaacaagctcgctatcaaggagtagtttgtgccatgaaggaggcgtttggctttattgaaagaggtgatgttgtaaaagagatattctttcactatagtgaatttaaaggtgatctagaaaccctgcagcctggagatgacgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgaatcaaagttgactttgtgattcctaaagaacttccctttggagacaaagacacaaaatccaaagtgaccctgctggaaggtgaccatgttaggtttaatatttcaacagaccgacgtgacaaattagaacgagcaaccaacatagaggttctatcaaatacatttcagttcactaatgaagccagagagatgggtgtgattgctgccatgagagatggttttggcttcatcaagtgtgtggaccgtgatgctcgtatgttcttccacttcagtgagattctcgatgggaaccagctccacattgcagatgaagtggagtttactgtggtccctgatatgctctctgcccaaagaaatcatgctattaggattaaaaaacttcccaagggcacggtttcattccattcccattcagatcatcgttttctgggcaccgtagaaaaagaagccactttttctaatcctaaaactacaagcccaaataaaggcaaagacaaggaggcagaagatggcattattgcttatgatgactgtggggtgaaactgactattgcttttcaagccaaggatgtggaaggatctacttctcctcaaataggagataaggttgaatttagtattagtgacaaacagaggcctggacagcagattgcaacttgtgtgagacttttaggtcgtaattctaattccaaaaggctcttgggttatgtggcaactctgaaagataattttggatttattgaaacagctaatcatgataaggagatatttttccattatagtgagttctctggtgatgttgatagcctggaactgggagacatggttgaatacagcttgtccaaaggcaaaggcaataaagtcagtgctgagaaagtaaacaaaactcactcagtgaatggcatcactgaggaagcaaatcccaccatctactctggtaaagtcattcgtcctctgagaggcgttgatccaacacagattgaataccaaggaatgattgagattgtggaggagggggatatgaaaggtgaagtgtatccttttggcatagttgggatggccaacaaaggggattgcctacagaaaggggagagtgttaagttccagttgtgtgtacttggccaaaatgcacaaactatggcctacaacatcacaccccttcgtagggctactgtggagtgtgtgaaagatcagtttggctttattaactatgaagtaggagatagcaagaagctctttttccatgtgaaggaagttcaggatggcattgagctacaggcaggagatgaggtggaattctcagtgatccttaatcagcgcactgggaaatgtagcgcctgtaatgtttggcgagtctgtgaaggccccaaagctgttgcagctcctcgacctgatcggttggttaatcgcttaaagaacatcaccctggatgatgccagtgctccacgtctaatggttcttcgtcagccaaggggaccagataactcaatgggatttggtgcagaaagaaagatccgtcaagctggtgtcattgactaaccacgtccacaaagcacatcattaatccactatggtcaagttggggggattctggtgaagggttctgaatatcttcctcttcatccctcccaaaatctggaatacttattctattgagctattacaccagttttaacaccttcctcgtgttatgtttaaagaaaaaataaataaatttaagaaaccattttaaaattatgcacagttgcagcctggaaaacttaaggtggcgccttatagtgtcaatttaggagctttatttggtgcatttaacgcaactggtaattgcaaattccacttggcctgtgtaagtgaacaaaacagactgttactttgttggccctatgaaattctgcactctagtcagtatatatactctaccttcatgacttaatactcagctgcattcttttccttttttccctctgttcattatgctttaattctgaggaccatatgaaggtagaatatattacctttaaaaattgcaaaatttatatagcaaacgattttcttaagttgatggccaaatgttaaaatgttattttcatatcatttataatcttgtcacaatccacttaacgaagtttgattacatttcagtgaaaattatcttccataataggttttttttttccttcctgggatggggggcaaataactttactacaattagtatgtatggtgcagaatttcatgcaaatgaagtgtgccagcagtgtgataatttaaacatatttaaacaaaagacgaatgcacaaaattgctgctgcttagatcactgcagcttctaggacccagtttcttttactgatttaaaaacaaaatgaaaaaaaaataataaaaaagttgtgcctgaaatgaatcctgttttttttataagtagccccctggttccagtgccctgttgaatacaggcacttgatccttggtgcagcttctgttcaactttgtatcacgggaacggattggcctgatttcttggccttcctcttgaattggccccaaacagggtccctggcaagtggagtgaaggctttttgtctaaagatgacaagggtcagctcaggggttgtgggggagggcgttttcatcttccccgttgtcacttgaggttttgaactctgggtaaagaggccgtttatctttgtaaacacaaaacatttttgctttctccggtttcatgttaatggcgaaagaatggaagcgaataaagttttactgatttttgaaaaaaaaaggaattc

SEQ ID NO: 2471 - DNA, 889 bp, Rattus norvegicus
  Genbank Accession No. NM_054008
tgaacacccgagcggaccgcagtgcaggcggcagccaccagggccaacacctctcagcatctctactacacgtgtcactgagcaacctctccatgaagccgccctccacgcagagcagccccgcggccgtggcggccgcagccccggccatggactccgcggccgctgcagacctgacggacgtgctgtgcgagttcgacgcggtgctggccgacttcgcgtcgcccttccacgagcgccacttccactatgaggagcacctggagcgcatgaagcggcgcagcagcgccagcgtcagtgacagcagcggcttcagcgactccgagagtgcagactcgttgtacagggacagcttcaccttcagtgatgagaagctgaattctccgacggactccactccagccctcttgtcctccgctgtcactcctcggaaagccaaattaggtgacactaaagagctcgaagacttcatcgctgatctggacagaaccttagcaagtatgtgaagcaaggagtttgagattcttatgccacaagagtgaaactccagaaggctacgccaggccctggcaaaatcggctactaagtctgctgtgggagcgggcagagctcgcggcatccggccgttcttggttcgccataactttagccattgggtccatctctgggcagttcagataatgaggctgactttgtttacctgcctgcaccatattcaacagatgatctatctaatgtgtttttactccttaaacatagctcttctataaattaaagtgcttttatggaaatatttgtaattacttatatatagttggaggtcataataagctttcccatcataatatatttttgtatacaaataaaatttaaactgggatctgtacct

SEQ ID NO: 2472 - DNA, 1742 bp, Rattus norvegicus
  Genbank Accession No. NM_057097
gagccgcgcactcgagggagcttctgccgccgccgccgccgccgccgccgccgccgccgccgccgccgccgccgccgccgccgccgccgccgccgccgccgaaatgtctacaggggtgccttcagggtccagtgctgccactggcagtaatcgaagactccagcagacacagaatcaagtagatgaggtggtggacatcatgagagtcaatgtggataaggtgttagaaagagaccagaagctctcagagctagacgaccgcgcagatgcactgcaggcaggcgcctcgcagtttgaaacaagtgctgccaagttgaagagaaagtattggtggaagaactgcaagatgtgggcgatagggatcagtgtcctggtgattattgtcattatcatcattgtgtggtgtgtctcttaatgaagaacagaggaaatgaagcctgacggcaggatcttcttcgagactttctacttagaactgcgtgttgtcgcacttcccatgattatttgtgttagtttacatacagttcagtgcctagatgttttttttttttttcccaaaaatgtgcctttgtttttcatatacactcgaggtgtgacctgccctgcccacattttgcacagtgcctttacagatttatggactgggaaagaggacttgtgtgtttcagagtgctgagatctaggtggatgttgtcactgatggcttgtggattcaaggaagaggattttgttcaagtcagctgtccccacacctaacatggacttcaaaaccacagtttaaacctttgggtaattagattcccaacttggaccttccaagaagaacactactgcctaacaaaaatcagtgacaacagcagggcgtgccttattttgataactaggtaacttttcattaagagtacttttgtaagcactaccgaccccgctgtatttaagatgctggtgaagagctcatgctcttatgttagatacggagatgttcactttctagttcttgttgtgtatcacttctaaaacagtattttaatcagaaataaccctttaggaagtttttatagaactgtgaccaaagtttctattttgccaaaagttaaatacaaatgaattgtccataagtttgtcccccagtagtaaattcaaataagtgccaagtgtaactcaaggtgccctttaagaaaaaatgttagtactgtctgagcccgcagcatcttgacagtccttcctgtggaatgctgtaggtacagcttctcatcctgatgtggtttctttcctagagctatagaggtgacctcaaatcacacctgtatgcaagatagtagtttgcagactgcactagcctgtggccactagtgtgatgagagcagcatctgaagcctcacaaaggcaacagtctgcacagagttctgggagactgtggcagtgccaccaggatgtcctgaaatgtgtgtctgtgtgcaaagcagcattagccaaaatgtcataggatctggttctagttttttttatctgatcccctaacattaccgaaacaaaacaagtgttgaagacatgccttgccacatagctagggcctctgtcctggtctgaccccacaactttggtgctgtctcctcgtactctgtcccatgtaagtcgttggctcctgtattaacacagtaatacctcgcttctctgtgcatttagctgggaatgttcccgctatggtgaccggaataaagttattaacatgaaaaaaaaaa

SEQ ID NO: 2473 - DNA, 2573 bp, Rattus norvegicus
  Genbank Accession No. NM_057100
ccgggctcccggcccgggcctcgccatgccgccaccgcccgggcccaccgccgccctgggcactgcgcttctgctgctcctgctggcctccgagtcttcgcacactgtgctgttgcgggcgcgtgaggcggcgcagttcctgcggcccaggcagcgccgcgcctaccaagtcttcgaggaggccaagcagggccacctggaacgggagtgcgtggaggaggtgtgcagcaaggaggaggctagagaggtgttcgagaacgaccccgagacggactatttctatccaagatatcaagagtgcatgaggaaatatggccggcccgaagataaaaacccaaatttcgccacctgtgttaagaacttacctgaccaatgcaccccaaacccctgtgataagaagggcactcaactctgccaagacctcatgggcaacttcttctgcttgtgcaaagatggctggggaggccggctctgtgacaaagatgtcaacgagtgtagtcagaagaatgggggctgcagccaggtctgccataacaaaccaggaagcttccaatgtgcctgccacagtggcttctcacttcaatcagacaacaagagctgccaagatatagatgaatgcacagactcagacacctgtggggatgcgcgttgcaagaaccttccgggctcctactcctgcctctgcgacaaggggtacacttacagctccaaggagaagacctgccaagatgtggatgagtgccagcaggaccgttgtgagcagacctgtgtcaactccccaggcagctatacctgccactgtaatgggcgcgggggcctaaaactgtccccagacatggatacctgtgaggacatcttaccgtgtgtgcccttcagcatggccaagagcgtcaagtccttgtacctgggccgcatgttcagcgggacccccgtgattagactacgcttcaagaggctccagcctaccaggctgctggccgaatttgacttccgtacttttgaccctgagggagtcctcttcttcgccggaggtcgctcggatagcacctggatcgtcctgggcctcagggctgggcgacttgagttgcagctacggtacaatggcgttggacgcatcaccagcagtgggccaaccatcaaccacggcatgtggcaaacgatctctgtggaagaactggaccgcaaccttgtcatcaaggtcaacaaagatgccgtgatgaagattgcggtggctggggggctgttccagctagagagaggcctgtaccacctgaatctcactgtggggggcattcccttcaaggagagtgacctcgtccagccgattaaccctcgcctggacgggtgcatgaggagctggaactggctgaatggggaagacagtgccattcaggaaacggtcaaggccaatacaaaaatgcagtgcttctctgtgacagagaggggctccttcttcccggggaatggatttgccttctatagcctcaactacacccggacatcgctggatgtcggcacggaaaccacctgggaagtagaagtcgtggctcgcattcgccctgccactgacacgggggtgctgatggcactggtgggggacaaagacgtcgtcctcctctctgtggccctggtcgactaccactccacaaagaagctcaagaagcagctggtggtcctggcagttgagaatgttgccctggccctgatggaaatcaaggtgtgcgacagccaggaacacactgtcactgtctccctgcgggatggcgaggccaccctggaagtggatggtaccaagggccagagcgaagtgagcaccgcacagctgcaggagcgactggacctgcttaagacacgtctgcaaggctccgtgctcacctttgtggggggcctgccagatgtacaagtgacttccacacccgtcacggcgttctaccgtggatgcatgactctggaggtaaacgggaagaccctggacctggatacggcctcctacaagcacagtgacatcacctcccactcctgcccgcctgtggagcacgtcacagcctagaccgagctgcaagagttctctacacctaaaagacacggtgaagcagggtcagggacacacagcaccatctcctctcgcatgggccctgcaacactggagcaggtgcagggctacgatgggtactacgtactgtccgtggagcagtaccccgagctggctgacagtgccaacaacatccagttcctgagacaaagcgagatcggcaagaggtaacccccgggccacccctgcgcagattctcctgtagcacaaaccgaaccggactctccaaagagccttccagaatgacactgctctgcagacaccctcggcgcagacacaggcaacacaaaccagaaacaaagacgactttttttttctctaaatgaccttaaaggtgatcggctttaaagaatatgtttacatacgcatatcgctgcactcaattggactggaagtatgagaaggaaaaaaaagcattaaaaaggcaacgttttgccatgaccctctgtaccttcgaggcactgtatttaacaaaagtttt

SEQ ID NO: 2474 - DNA, 1964 bp, Rattus norvegicus
  Genbank Accession No. NM_057101
ggttgggccatgctgctacctgggctgctgttgctgctgctgctgctgctgctagctggcacccgctggctgtggggtcagtggaagctctggaaactccgcctcccgcctctggccccggggtttctgcactttctacagcccaaccttccggtctacctgtttggcctggctcagaaacttgggcccatctacaggatccgcttggggctacaagatgtggtggtgttgaactctaacaaaaccattgaggaggccttgatccaaaagtgggtggactttgctggccgaccccagatactagatggaaagatgaactttgacctctccatgggggattattctctaacatggaaagcccacaagaaactctctcgttcggccctggtgctgggcatgagagactccatggaacctctggtagagcagctgacccaggaattctgtgagcgcatgagagcccaggccggtgcctctgtggccatccataaggaattctccttactcacctgcagtatcatcagctgtctcactttcggagacaagcaggacagcactttgctgaatgccactcacagctgtgtccgggacttgctgaaagcctggaatcactggtccgtccaaatcttggatataattccctttctcaggttcttccccaatccaggcctctggaaactgaagcagttccaggagagtagggaccatatcgtaatgcaggagctgaagaggcacaaggacagcctggtggcagggcagtggaaagacatgattgactacatgctccagggtgtggagaagcaaagagatgccagagacccagggcagctccacgagcggcacgtgcatatgtcggtggtggacctttttgtcggtggcacggagaccacggctgccacgctctcctgggctgtggctttcctgcttcaccaccctgagatccagaagcggctgcaggaagaattagacctcaagctggcccccagctcccagctcctgtacaagaaccgaatgcagctacctctgctcatggccaccattgctgaagtgctgcgtttgcggcccgtggtgcccatggccttgccccatcgtgcaactaaggctagcagcatctctggctatgatatccccaaggatacgatcatcatccccaacatccaaggcgccaacctggatgagatggtttgggaactgcccagcaagttctggcctgatcgcttcctggaatccggcaagagtcccagaataccgacctttggctgtggggcacgcgtgtgcctgggcgagcctctggcgcggctggagttcttcgtggtgctggctcgcctgctccagaccttcacgctgctgccgccaccagatggtaccctgccctccctgcagcccctgccgtatactggcatcaatctcttaattcctcccttccaggtgcggctgcagcccaggaacctggcaccccaagaccagggccagaaatcctcgacaggataggacgagccttgtgcctcagtttctcctttattgctccattcccctcccctcccccctgtaaacatggtgctgtgagactgtggcagagaaggcttcctcggtgagctaggcacagtagagacacactggctcttctctgggcacaacccctcagtgctcggcagtcataccagggtgtgagtgaggtgggcagcaggctcaggtgcccctggtgggggcctggaagtttctgggtctcagcttcatttccgtgaagggcaccgagaactcgaagcccttccagtggtaccagctcactccctgagggaagggttgtcaagggaggagagtcaagacaacgccacatctatgccaccttatccatcccaaccctggctcctctaggtgactcccagagtgcagccatctccccccatgatccctgaagtgatgtcctctcccacccgctaataaacggtcttttcaagattccc

SEQ ID NO: 2475 - DNA, 5236 bp, Rattus norvegicus
  Genbank Accession No. NM_057103
cgggccggcgggagtagaagagccactgagccatgggcgcaggcagttccaccgagcagcggagccccgagcagccggcggggagcgacacgccgagcgagctggtgctcagtggccatgggcccgcagctgaagcctcgggagcagctggagaccccgccgacgcggaccccgccaccaagctcccacagaagaatggccagctgtcttctgtcaacggcgtagctgaacaaggagatgtccatgtccaagaggaaaaccaggaggggcaggaggaagaagtcgttgatgaggatgttggacagcgagagtcagaagatgtgagagaaaaagaccgagttgaagaaatggcggccaactccacagctgttgaagatatcacaaaggatgggcaggaggagacatcagaaataattgaacagatccctgcttcagaaaacaatgtggaagaaatggtacagcctgctgagtcccaggctaatgatgttggcttcaagaaagtatttaaatttgttggttttaaattcacggtgaagaaggataaaaatgaaaagtcagatactgtccaactactcactgtcaagaaggatgaaggcgaaggggcagaagcctctgtcggagctggagaccaccaggagcccagtgtggagactgccgtcggagagtcagcatccaaagaaagtgagctgaagcaatccacagagaagcaagaaggcaccctgaagcaagaacagagcagcacagaaatcccccttcaagccgaatctgatcaagcggctgaggaagaagccaaagatgaaggagaagaaaaacaagagaaagagcccaccaagtccccagaatccccgagcagcccagtcaacagtgagacaacatcttccttcaagaagttcttcactcacggttgggccggctggcgcaagaagaccagcttcaagaaatcaaaagaggatgatctggaaactgccgagaagagaaaggagcaagaggcagaaaaagtagacgaggaagaaaaggaaaagacagagccagcctcggaggagcaggagccggcagaagacacagaccaggccaggttgtcagcagactacgagaaggtggagctgcctttggaagaccaggttggtgacctggaggcatcgtcagaggagaagtgtgctcctttggcaacggaagtgtttgatgagaagatggaagcccaccaagaagttgttgcagaggtccacgtgagcaccgtggagaagacagaggaggagcagggaggaggaggagaggctgaagggggcgtggtggtagaaggaacaggagaatccttgccccctgagaaactggctgagccccaggaggtcccccaggaagctgagcctgctgaggagctgatgaagagcagagagatgtgtgtctctggaggagaccacactcaactgacagacctaagtcctgaagagaagacgctgcccaaacacccagaaggcattgtcagtgaggtggagatgctgtcctctcaggaaagaatcaaggtacagggaagtcccttgaagaaactcttcagtagctcaggcttaaagaagctgtctgggaagaagcagaaggggaaacgaggaggtgggggagacgaagagcctggagaataccaacacattcacaccgaatccccagagagtgctgatgagcagaagggagagagctctgcgtcgtcccccgaggagcctgaggagaccacgtgtctggagaaagggccgctggaagcaccccaggatggggaagctgaggaaggaactacttccgatggagagaagaagagagaagggatcactccctgggcatccttcaaaaagatggtgacacccaagaaacgggtccgaagaccttctgagagtgacaaggaggaagagctggagaaggtcaagagcgccaccttgtcctccactgatagcacagtgtcagaaatgcaagatgaagtcaaaactgttggtgaggaacaaaagccagaggaaccaaagcgtagggtggatacttcagtgtcttgggaagcactgatttgtgtcggatcatccaagaagagagcaaggaaggcatcctcttcagatgatgaaggagggccaaggacactgggaggggacagtcacagagcagaggaggccagcaaagacaaagaagccggaacagacgctgttcctgccagcacccaggagcaggaccaagcgcaaggaagttcctcacccgagccagcgggaagcccttccgaaggggaaggtgtctccacttgggagtcatttaaaagattagtcactccaagaaaaaaatccaagtcaaaactggaagagaaagccgaagactctagtgtagagcagttgtccactgagatcgaaccgagtagagaagaatcttgggtttccattaagaaattcatccccggacggcggaagaaaagggcagatgggaagcaagaacaagccactgtggaagactcagggccagtggagataaatgaggacgaccctgatgtcccagccgtcgtgcctctgtctgagtatgatgcagtggagagggagaagatggaagcccaggggaatgcggagctgccccagctgctgggggctgtgtacgtgtccgaggagctcagtaagactctggtccacactgtgagtgtcgcagtcattgatgggaccagggcagtcaccagtgtcgaagagcggtctccttcgtggatatccgcttccgtaacagaacctcttgaacacacagcgggagaagccatgccacctgttgaagaggtcactgaaaaagacatcattgcagaagaaactcctgtgctcacccagacgttaccagagggtaaagatgcccatgacgacatggtcaccagtgaagtggatttcacctcagaagctgtgacagccacagagacctcagaggctctccgtactgaagaagttaccgaagcatcgggggccgaagagaccacagacatggtgtccgcagtttcccagctgactgactccccagacaccacagaggaagccaccccagttcaggaggtagagagtggtgtgctagatacagaagaagaggagcgccagacgcaggccatcctccaagccgttgcagacaaggtgaaagaggagtcccaggtgcctgcaacccagactgtgcagagaacggggtcaaaagcactggagaaggttgaggaggtagaggaggactccgaagtgctggcttcggagaaagagaaggacgttatgccgaaaggacccgtgcaggaagctggagctgagcatcttgcacagggctctgagactggacaggctactccagagagccttgaagttcctgaagtcacggcagatgtagaccatgtcgccacgtgccaggttatcaagctccagcagctgatggaacaggccgtggcccctgagtcatccgaaaccttgacagacagtgagacaaatggaagcactcccttagcagattcagacactgcagatgggacacagcaagatgaaaccattgacagccaggacagtaaagccactgcagctgtcaggcagtcacaggtcacagaagaagaggcggctactgctcagaaagaggagccttcgacactacctaataatgttccagcccaggaagaacatggggaagaaccaggaagagatgttcttgaacctacacagcaagagcttactgctgcagccgtgcccgttctggcaaagactgaggtgggtcaagagggtgaggttgactggttggatggagaaaaagtcaaagaagaacaggaggtgtttgtacactctggacccaacagtcaaaaggctgctgatgtgacatatgacagtgaagtgatgggagtggccgggtgtcaggaaaaggagagtactgaagtgcagagtcttagcctggaggagggagagatggaaactgacgttgaaaaggagaaaagggagacaaagccagagcaagtgagtgaagaaggtgagcaggaaacagccgctcctgagcatgaaggaacctacgggaagccagtcctgacacttgacatgcccagctcagagagggggaaggcactgggaagccttggaggaagcccttctctcccagaccaagacaaagcaggttgcatagaggttcaagttcaaagcctggacacaacagtcactcaaacagcagaagctgtggaaaaggtcatagaaacggttgtgatttcagagacaggtgaaagtccagagtgtgtaggtgcacacttattaccagctgagaagtcctctgcaacgggtggccactggactcttcagcatgcagaggacacggtacccctggggcctgagtctcaggcagaatccatcccaatcatagtaactcctgctcctgaaagcaccctacatcctgacctacaaggagaaataagcgcatcccagagagagcgatcagaggaagaggacaagccagatgctggtcctgatgctgacggcaaggagagtacagcaatcgaaaaagtcctcaaggctgaacctgagatcctggaacttgagagtaagagcaacaagattgtgctgaacgtcattcagacagccgttgaccagttcgcacgtacagaaacagcccccgaaactcatgcttatgattcacagacccaggttcctgcaatgcaggctgacagcagggagcccaacagatgctggacaaaaatgaaagttgccaagatgaaacacccagtgccgcagcccagagaggacttgcaagtcctgaccgttctggaggcatgggctcagcctcggaaatgcttgccgcgcttgcagttgaaagcgccggtgtcaaagtaagcattgagaagctgcctcctcaacccaaagatcaaaaggagcatgctgctgatggccctcagctccaaagcttagcccaggcagaggccagtgcctctggaaacctaaccaaagaatccccagacaccaacggaccaaagctaaccgaggagggcgatcgcccaaaagttgaggtccaggaagaagaaatgtctaccaagtcagtcaaagagaacaaggcccaggcagaagaggacctgcaggagccaaagggagacctggcagaatcctaagatgttagttgctcattgtacatctgtaagaccagaatgtgaaaacaagtcacagaacaagatgctgctgttgggaccttgagaccaagatttcagagcccatgagatccagagagcagggccgtccaatgatttccaccc

SEQ ID NO: 2476 - DNA, 3216 bp, Rattus norvegicus
  Genbank Accession No. NM_057104
ggtacccaacagcctgaactcagagccccgagagcagagcattcagggcaagcagaaacaccctgcagaggctttccaagaatccctcggcatggcaagacaaggctgtctcgggtcattccaggtaatatccttgttcacttttgccatcagtgtcaatatctgcttaggattcacagcaagtcgaattaagagggcagaatgggatgaaggacctcccacagtgctgtctgactctccatggaccaacacctctggatcctgcaaaggtagatgctttgagcttcaagaggttggccctccagactgtcggtgtgacaacctgtgtaagagctacagcagctgctgccacgatttcgatgagctctgtttgaaaacagtccgaggctgggagtgcaccaaagacagaagtggggaagtacgaaacgaggaaaatgcctgtcactgcccagaagactgcttgtccaggggagactgctgtaccaactaccaagtggtctgcaaaggagaatcacactgggtagatgatgctgcgagaaatcaaagttccgaatgcctgcaggtttgtccgcctccgttaatcatcttctctgtggatggtttccgtgcatcatacatgaagaaaggcagcaaggttatgcccaacattgagaaactgcggtcctgtggcacccatgtcccctacacgaggcctgtgtaccccacaaaaaccttccctaatctatatacgctggccactggtttatatccggaatcccatggaattgtcggtaattcaatgtatgatcctgtctttgatgcttcgttccatctacgagggcgagagaagtttaatcataggtggtggggaggccaaccgctatggattacagccaccaagcaaggggtgagagctggaacattcttttggtctgtgagcatccctcatgaacggaggatcctaaccattcttcagtggctttctctgccagacaacgagaggccttcagtttatgccttctactcagagcagcctgatttttctggacacaagtacggcccttttggccctgagatgacaaatcctctgagggagattgacaagaccgtggggcagttaatggatggactgaaacaactcaggctgcatcgctgtgtgaacgttatctttgttggagaccatggaatggaagatgtgacatgtgacagaactgagttcttgagcaactatctgactaatgtggatgacattactttagtgcctggaactctgggaagaattcgagccaaatctatcaataattctaaatatgaccctaaaaccattattgctaacctcacgtgcaaaaaaccggatcagcactttaagccttacatgaaacagcaccttcccaaacggttgcactatgccaacaacagaagaattgaagacatccatttattggtcgatcgaagatggcatgttgcaaggaaacctttggacgtttataagaaaccatcaggaaaatgttttttccagggtgaccacggctttgataacaaggtcaatagcatgcagactgttttcgtaggttatggcccaacttttaagtacaggactaaagtgcctccatttgaaaacattgaactttacaatgttatgtgcgatctcctaggcttgaagcccgctcccaataatggaactcatggaagcttgaatcacctactgcgtacaaatacctttaggccaaccatgccagacgaagtcagccgacctaactacccagggattatgtaccttcagtccgagtttgacctgggctgcacctgtgacgataaggtagagccaaagaacaaattggaagaactcaataaacgtcttcataccaaaggatcaacagaagctgaaaccgggaaattcagaggcagcaaacatgaaaacaagaaaaaccttaatggaagtgttgaacctagaaaagagagacatctcctgtatggacggcctgcagtgctctatcggactagctatgatatcttataccatacggactttgaaagtggttatagtgaaatattcttaatgcctctctggacatcgtataccatttctaagcaggctgaggtctccagcatcccagaacacctgaccaactgtgttcgtcctgatgtccgtgtgtctccaggattcagtcagaactgtttagcttataaaaatgataaacagatgtcatatggattcctttttcctccctacctgagctcctccccagaagctaagtatgatgcattcctcgtaaccaacatggttccaatgtaccccgccttcaaacgtgtttgggcttatttccaaagggttttggtgaagaaatatgcttcagaaaggaatggagtcaacgtaataagtggaccgatttttgactacaattacgatggcctacgtgacactgaagatgaaattaaacagtatgtggaaggcagctctatacctgtccccacccactactacagcatcatcaccagctgcctggacttcactcagcctgcagacaagtgtgacggtcccctctctgtgtcttccttcatccttcctcaccgacccgacaatgatgagagctgtaatagctccgaggatgagtcgaagtgggtagaggaactcatgaagatgcacacagctcgggtgcgggacattgagcacctcactggtctggatttctaccggaagactagccgtagctattcggaaattctgaccctcaagacatacctgcatacatatgagagcgagatttaactttctgggcctgggcagtgtagtcttagcaactggtgtatatttttatattgtgtttgtatttattaatttgaaccaggacacaaacaaacaaagaaacaaacaaataaaaaaaaaaaccacttagtattttaatcctgtaccaaatctgacatattaagctgaatgactgtgctattttttttccttaattcttgatttagacagagttgtgttctgagcagagtttatagtgaacactgaggctcacaatccaagtagaagctacgtggatctacaaggtgctgcaggttgaaaatttgcattgaggaaatattagttttccagggcacagtcaccacgtgtagttctgttctgttttgaaagactgattttgtaaaggtgcattcatctgctgttaactttgacagacatatttatgccttatagaccaagcttaaatataataaatcacacattcagatttt

SEQ ID NO: 2477 - DNA, 1593 bp, Rattus norvegicus
  Genbank Accession No. NM_057105
atggcttgccttcttcctgctgctcgacttcctgcaggctttctcttcttagtgctctggggctcagttctaggtgacaagctgctggtggtcccccaggatggcagccactggcttagcatgaaggagatagtggagcacctcagtgaacgcggacacgacattgtggtgctagtgccagaagtcaatttgcttttgggagaatccaaatactacaggaggaaaagcttcccggtcccctacaacctagaagagttgcggacccgctatcgctcctttgggaacaaccactttgctgccagttcccccctgatggctcctctaagagagtacaggaacaacatgattgtcattgacatgtgctttttcagctgccagagcctcctgaaggactcggccaccctcagcttcctcagggagaaccagtttgatgctctgttcacagacccggccatgccctgtggtgtgatcctggctgagtatctcaagctgccttccatctacctcttcagaggtttcccatgctctctggagcacatgcttggtcaaagcccaagccccgtatcctatgttcccagattctacaccaaattctcagaccacatgacatttccccaacggctggccaacttcattgctaacatcttggagaactacctttatcattgtctgtactcaaagtatgagatccttgcctcagacctcctcaagagagatgtgtccctacctgccttacaccagaactctctgtggctgttacggtatgattttgtgttcgaatacccccggccagtcatgcccaacatgatcttcattggagggaccaactgcaagaagaaggggaacctgtctcaggaatttgaagcctatgtcaacgcctccggagaacatggcatcgtggttttctctttgggatccatggtctcagagattccagagaagaaagcgatggaaatcgctgaggctttgggcagaattcctcagacggtcctgtggcgctacaccggaactagaccatcgaaccttgcaaagaacactattcttgtcaaatggctaccccaaaacgatctgcttggtcatccaaaggctcgggcgttcatcacacactccggttcccatggtatttatgaaggaatatgcaatggggttccaatggtgatgatgcccttgtttggtgatcagatggacaacgccaagcgcatggaaactcggggagctggggtgaccctgaatgtcctggaaatgactgccgatgatttggaaaacgcccttaaaactgtcatcaataacaagagttacaaggagaacatcatgcgcctctccagccttcacaaggaccgtcctatcgagcctctggacctggctgtgttctgggtggagtacgtgatgaggcacaagggggcgccacacctgcgccccgccgcccacgacctcacctggtaccagtaccactccttggacgtgattggctttctcctggccatcgtgttgacggtggtcttcattgtctataaaagttgtgcctatggctgccggaaatgctttgggggaaagggtcgagtgaagaaatcacacaaatccaagacccactga

SEQ ID NO: 2478 - DNA, 882 bp, Rattus norvegicus
  Genbank Accession No. NM_057114
ggctcacggttggttctgtttgtgagacctgtagctcgactctgctgatagcaagatgtcttcaggaaatgcaaaaattgggcatcctgctcccagcttcaaagccacggctgttatgccggatggacaattcaaagatatcagcctaagtgattacaaaggaaaatatgttgtattctttttttaccctcttgactttacttttgtgtgtcccacggagatcattgctttcagtgatagagcagaagaatttaagaaactcaactgccaagtgattggagcttctgtggattctcacttctgtcatctggcatggattaacacacccaagaaacaaggaggattgggacccatgaacattcccttggtatcagatcccaagcgcaccattgctcaggattatggagtcttaaaagctgatgaaggtatctctttcaggggcctctttattattgatgataaaggtatccttcgccagataacaataaatgatcttcctgttggccgctctgtggatgagattctgagactagtccaggccttccagttcactgacaaacatggtgaagtgtgcccagctggctggaaacctggcagtgataccatcaagcctgatgtcaataagagtaaagagtatttctctaagcagaagtgagcactggaccagttttctggcagacagctttgagcagccagaagaaatttgtactctacacatgacgtggtgtgattccagataagcctttcctacaagggctaggggtggttagcctttcttccactattggtaaggggcagaccatcttatatcagtcacagaaaccaacctgttaattctctctctctcttttttttttttaagtatctattaaacgtgaattc

SEQ ID NO: 2479 - DNA, 1978 bp, Rattus norvegicus
  Genbank Accession No. NM_057119
gtggtgcggagcgagtcgactttggactactctcttagcgtggcgtcgcgcgaggctgcggcggagcctctgtcaggaaggcgggagcttgacagcttcagtaaagaccagcagcggtgacagcaacccggagtcatgagcgacagcggcgagcagaactacggcgagcgggaatcccgttctgcttcccgaagtggaagtgctcatggatcggggaaatctgcacggcacacacctgcaaggtctcgctccaaggaagattcaagacgttctagatcaaagtcaagatccagatctgaatctaggtctagatccagaagaagttctagaaggcattatacaaggtcacgatcacgatctcgctctcatagacgatcccggagcaggtcttacagccgagactatcgcagacgccacagccacagccattctcccatgtctactcgaaggcgtcatgttgggaaccgggcaaatcctgaccccaactgttgtcttggagtgtttggattgagcttgtacaccacagaaagagatctaagagaagtgttctctaagtatggccccattgctgatgtgtctattgtgtatgaccagcagtctagacggtcaagaggatttgcctttgtatattttgaaaatgtagatgatgccaaggaagctaaagaacgtgccaatggaatggagcttgatggacgtcggattagggtcgatttctctataacaaaaaggccccataccccaacaccaggaatttatatggggagacccacttatggcagttcacgacgccgggactattatgaccgaggatatgatcggggttatgatgaccgggactattacagcagatcatacagaggaggaggtggaggaggaggtggatggagagcagctcaagatagagatcagatttacagaaggcggtcaccttctccttactacagtcgtggaggatacaggtctcgttctcgatcaagatcctactcacctcgtcgctattaaagcatgaagttgaagactttctgagacctgccatagagctgggatgttgtttgtggacaatattttctattgtctcctgtttaaaaagtgaacagtgcctagtgaagttaggtgacttttacaccttttatgatgactacttttggtggagttgaaatgctgttttcattctgcatttgtgtagttcggtgctttgttcaaagttaagtgttttcagaaaagtatgttttgcatgtatttttttacagtccaaattttgactgctgagaagtttctattgtacaaaacttcatttaaaaggtttttctactgaatccagggtattctgaagatcgaagcctgtgtgtaaaatgctaccagatggcaaaaagcaacaataaacaagtttgatttttacttttctttctaaatatcaatgcttaacaagaaccattcttaagttatcagtaaaaaataaataaataaaaattttctttcaggagtccatgaaacttgccatattcgatatacctgcaattaagtgttaaaaatacgctgtaactctgtactgctagtattagaacaagaatctttccatacagctaatgcttaatgcttacattaatgtggatttgtcggcctttatgtaatctgtattatatatagcaggggataagagctacagatagatacatgcctttaaaaggctgtttcttaaggctgttacaaggagataatggtatttcaactaatcagcaagtgacaatacattccaccacaaatgtactcttgttcttctagcctttagactatgaaaatactgggtgcttcaaagtatggaatgagagaagggatcaccacacctgtgtcatggatgaagactgcctgttcattttttaaatatgattttcaggtcctttgcttaccaaaggaagcccaattcactcaaatgttttgagaactgtttaaataaacaagcaagaaaaattgctgatgc

SEQ ID NO: 2480 - DNA, 1556 bp, Rattus norvegicus
  Genbank Accession No. NM_057123
acgactgaaggagagatgggtcaaagtcagagtggtggccatggtcctgggggtggcaagaaggatgacaaggacaagaaaaagaaatatgaacctcctgtcccaactagagtggggaaaaagaagaagaaaaccaagggaccagatgctgccagcaaactgccactggtaacacctcacacccagtgccgcctgaaattactaaagctggagagaataaaagactatcttctcatggaggaagaattcattagaaatcaggaacagatgaaaccactagaagaaaagcaagaggaggaaagatcaaaggtggatgatcttaggggaaccccgatgtctgtaggaaccttggaagagatcatcgatgataatcacgccattgtgtccacatcggtgggctcagaacactacgtcagcatcctgtcatttgtagacaaggatctgctggaaccgggctgttcagtcctgctcaaccacaaggtgcatgctgtgataggggtgctcatggatgacacggatcccctggtcacagtgatgaaggtggaaaaggccccccaggaaacctatgcagatattgggggactggacaaccagatccaggaaattaaggaatctgtggagctccctcttacccaccctgagtattatgaggagatggggataaaaccacctaagggggtcattctctacggcccgccaggaacaggtaaaactctattggccaaagcagtagcgaaccagacttcagcgactttcttgcgagtggttggctcagagcttattcagaagtacctaggtgacgggcccaagctggtccgggagctcttccgggtcgctgaggaacacgcaccgtccattgtgttcattgatgaaatcgacgccattgggaccaaaagatatgattcaaactctggaggtgagcgggaaatccagcggacaatgttggaactgttgaaccagttggatggatttgattcgaggggagatgtaaaagttatcatggccacaaaccgaatagaaactttggatccagcacttatcagaccaggccgcattgacagaaagatcgagttccccctgcctgatgaaaagaccaagaagcgcatcttccagatccacacaagcaggatgacgctggctgatgatgtaaccttggatgacttgatcatggcaaaggatgacctctctggggctgacatcaaggcaatctgcacagaggctggcttgatggctctgcgggaacgcaggatgaaagtgacaaacgaagacttcaagaaatctaaggagaacgttctgtataaaaaacaagaaggcacccctgaggggctgtatctctagtgacacagttgtcttcagggaacttaatgagtttcccccacctgggaagatgggaagctgccccaaggaatccatcttccagttaagttttgctagtagaaagcccgtgtcgtggaggacgctgtgtggtctgtctccaatctgttgttggtcattgtgccctgcagctctccgctcccaataaaggattgtcctggtttgctttctaaaaaaacaag

SEQ ID NO: 2481 - DNA, 3169 bp, Rattus norvegicus
  Genbank Accession No. NM_057125
cggctccagtctccctcgccatggcgcttgctgtattgcatgtcctagaacccttcccgactgagacaccaccgttggcggtgctgttgccgcccgggggcccgtggccagtgaccggggtaggcctggtgctggcgctacggccggcgagcgaaagtcctgcgggacccgcgctgctcgtggcggccgtggaagggtccggcgcccaatgcgagcagcgagggcccgggcctccgccgctgctggtgagccgcacgctgctgcgggtcctagcgctgagccccggagcgagagtgcgagcgcggcctgtgcggcggcctccagccttgggctgggcgctgcttggcacgtctccgggtcctgggcttgggcctcgagtcgggccgctgctggtgcgtcgcggggagacactaccggtgcccggttctcgagtgttggagacgcgaccggccttgcaagggttgctgggcccggggacacggctagctgtaactgagctccaggggcggaccaaactggacccggagagtagggaccacaaccatcccccacccccgcccgtagtttcctcctttgcagtttcccactcaatccggcagctccgaggagttctgggagggactggagatgcactaggtgtgagccggagctgtctccggagtctcgggctcttccagggcgaatgggtatgggtggcccgagtcggagagttaccaaacacctcccagccgcacttggctcaagtacaggttctagagcctcgctgggacctgtccgcgagactgggacccaactctgggcagccgggagagccactcgcggacggactggtgtttgtgcctgccactctagcttttaatctcggctgtgaccccctggaagtgggagagctcagaattcagaggtatctggaagactctactgctgctgaggacaaaggaagctgctcactactgcctgggcctccgtttgctcgagagttacacatcgaagttctgccctcgcctcactgtggtgtcaatgggaaatatgaccatgttctctaccagcacttccacacgcccagggtggtccaggaaggggatgttctgtgtgtgtcaacggctgggcaagttgagatcctggaaggaagcctggagagactgcccaggtggcgggaggtgtttttcaaagtgaagaaaacggttggagaagccccagatgggccagccagtgccttcctggccgataccacacacacctctttatacctggctggtaccaccctgagtcgtgtccccccgctgccttcaggaaggtccccaccctgggacagcttgtctcctccaggcctggaggccttggtaaatgagctgtgtgctgtcctgaagcctcatctgcagcccggaggaacactgctcacaggaaccagctgtgtgctcctgcagggtcccccaggcagcgggaagaccaccgcggtcacagctgcatgcagtcgcctcgggctccatctgctgaaggtgccttgctccagcctctgtgcagatagcagtaggactgtggagacaaagctgcagaccaccttctcccgggcccgccgctgcaggcctgtggtcctcctgctgacagccctggaccttctgggccgggaccgagatgggctgggtgaggatgcccgcgttgtggccacactgcgtcacctcctcctcgatgaggaccctctgagcaggtgccctcctctcatggtggtggccactacaagccgtgtccaggacctgcccaccgatgtgcggacggcatttcctcatgagctggaggtgccagtgttgtctgagagtcagcggctcagtgtcctgcaggccctcactgcccatcttcccttgggccaggaggttaacctgtcacagctggcacggcgctgtgcgggctttgtggtaggggacctctatgcccttctgacccatgccagccgggcagcctgcaccaggatcaaagctgcaggcttggcgatgagtgaggaggatgagggggagctgtgtgccgctggctttcccctgttggccgaggacttcgggcaggcgttagatcaactacaaacggctcactcccaagcagtaggagcgcccaagatcccttcagtgtcctggcacgatgtgggtgggctgcaggatgtgaagaaggagatcctggagaccatccaactgcctctggaacaccctgagctgctaagcctgggcctaagacgatcaggccttctgctccatgggcccccaggcactggcaagaccctgctggccaaggcggtagccactgagtgcagcctcacctttctcagtgtaaaggggccagaactcatcaacatgtatgtgggccaaagtgaggagaatgttcgggaagtgtttgccagggccagggctgctgccccgtgcatcatcttctttgatgaactggactccttagctccgagccgtggacggagtggagactctggaggtgtgatggacagagttgtgtctcagctcttagctgagctggacgggcttcacagcactcaggatgtgtttgtgatcggagccaccaacagaccagacctcctggatcctgcccttctgcggcctggcagatttgacaagctggtgtttgtaggagcaagtgaggaccgggcctcccagctgcgcgttctgagcgccatcacacgaaagttcaagctggaggcctctgtgagcctgatgaatgtgctggattgctgcccgcctcagctgaccggcgcagacctctattctctctgctctgacgccatgatgaccgccctcaaacgcagggtccgagacctagaggaagggctggagcctcggagctcagcactgttgctcaccatggaggacctgttgcaggccgcagcccggctgcagccctcagtcagcgagcaggagctgctgcgatacaagcgtatccaacgcaagtttgctgcctgctaggagcttcctgccgcctgcaaaagcccacctggctggaggtagctgccacctgccacctgaaggctgcctccctccaggagataccctgagatccctagtgggaggcccttgtgcccaggagaagaggcagggctggcagcttgggggcgtggcagcctggaatgggcattgaggccccagttctcagacagaaaataaagtctatactgccc

SEQ ID NO: 2482 - DNA, 2563 bp, Rattus norvegicus
  Genbank Accession No. NM_057141
attggtggatccatttagttcaagaaaatggagaccgaacagccagaagaaaccttccctaacaccgaaaccaatggtgaatttggtaaacgccctgcagaagatatggaagaggaacaagcctttaaaagatctagaaatactgatgagatggttgaattgcgcattttgcttcagagcaagaatgctggggcagtgattggaaaaggaggcaagaatattaaggctctccgtacagactacaatgccagtgtttcagtcccagacagcagtggccccgagcgcatactgagtatcagtgctgatattgagacgattggagaaattctgaagaaaatcatccctactttggaagagggcctgcagttgccatcacccactgcaaccagccagctcccgctcgaatctgatgctgtggaatgcttaaattaccagcattataaagggagtgacttcgactgcgagctgagactgttgattcatcaaagtctggccggaggaattattggtgttaaaggtgctaaaatcaaagaacttcgagaaaacactcagacaacaatcaagcttttccaggaatgctgccctcattctactgacagagttgttcttattggaggaaagcccgatagggttgtagaatgcatcaagatcatccttgaccttatatctgagtctcccatcaaaggacgtgcacaaccttatgatcccaacttctatgatgaaacctatgattatggtggttttacaatgatgtttgatgaccgccgaggacgacctgtgggattccccatgcggggaagaggtggttttgacagaatgcctcctggtcggggtgggcgtcccatgcctccttctagaagagattatgatgatatgagccctcgtcgaggaccaccaccaccaccacctggtcgaggtggacggggtggcagcagagctcggaatcttcctcttcctccaccaccaccacccagagggggagatctcatggcttacgacagaagaggacggcctggagaccgctatgatggcatggttgggttcagtgctgatgaaacttgggactctgcaattgacacatggagcccatcagaatggcaaatggcttatgaaccacagggtggttctggatatgattattcttatgcagggggccgtggctcgtatggtgatcttggcggacctattatcactacacaagtaactattcccaaagatttggctggatctattattggcaaaggtggtcagcggattaaacaaattcgtcatgagtctggagcatctatcaaaattgatgaacctttagaaggatctgaagatcggatcattaccattacgggaacacaggaccagatacagaacgcacagtatttgctgcagaacagtgtgaagcagtattctggaaagtttttctaagactagtgaagaactgaaggagtcctgcatctttttttttttatctgcttctgtttaaaaagccaacattcctctgcttcctaggtgttctgcatttgaggtgtagtgaaatctttgctgttcaccagatgtaatgttttagttccttacaaacagggttggggggagggcatgcaaaaaaactaacattgaaattttgaaacagcagcagagtgagtgacttttattttttgttcattgttggtggttttaaaaattccccccgtgtaattattgtgaacaccttgctttgtggtcactgtaacattggggggtgggacagggaggaaagtaatagtccacatgtccctggcatttgttcagagcagtgtgcagaatgtaatgctcttttgtaagaaacgttttatgatttttaaaataaatttagtgaatctatttttggtggtctttttttttttttttaaagacaatttcaaatggtggttgaattttccagcccacccctaaactaaacactaagtttgattttcagcagctcctctgttggatataagtgcacctcttggatatagacaaacacattggcaaatttcagtttgggtgatttcttaatggttggaaagacttggcttgataaatttccatcacatattcatgcttataataagcttgggattttgtttgtttttgcaaatgtttgccactacttttcaacagttttctgttagtcgtggggaactgcggtggggagcaatactacaagagtaagcatctgagtatgtgccagaagcctggtgggcaatgagctttattaaccagagtaacacttggttatggaagtggctgatgctgaataaatcctggttatttttgttagataatttctcacctatagacttaagctgtcaactgctagcgtcttgttagttgaactttgtaaaaatatatatatacttgtttttccattgtatgcacaatgaaagaaaaaagatgtaccatttctctgttgtgtgttgaattatgtaggaaatgtttgtgaacgattcaaaaaaaatggaaaagttcctgtggatgttttgtgtagtaacttggcatctgtattgatagttccaaatccacatctaaataaaacttcatgatgtta

SEQ ID NO: 2483 - DNA, 853 bp, Rattus norvegicus
  Genbank Accession No. NM_057144
tcatctcggcagattgactttggcccctgagtcttcaccatgccgaactggggtggaggtgcaaaatgtggagcctgcgacaagacggtttaccatgcagaagaaatccagtgcaatgggaggagcttccataagacctgtttccactgcatggcctgcaggaaggctctggacagcaccacagtggcagctcatgagtcagagatctactgtaaggtctgctatgggcgcaagtatggccccaaggggatcgggtttggacaaggcgctggctgcctcagcacagacaccggcgagcaccttggcctgcagttccaacaatccccaaagccagcacgtgcagccaccacgagcaacccttccaagttctctgcgaagtttggagaatcagagaagtgcccacgatgcggaaagtcggtatatgctgctgagaaggtcatgggaggtggcaagccctggcataagacctgctttccgtgcgccatctgtgggaagagcctggagtccacaaatgtcactgacaaggatggggagctttattgcaaagtttgctatgccaaaaattttggccccacaggcattgggtttggagggcttacacaccaagtggaaaagaaggagtgaaacggcgtgctttctcacagccctgctagtcaacagcagggcttagtgaccccatagatgtaactttggccccgcagcctcctttgtagctggactgcatttctcttcagaagcagtcataggctgcactgaccgtaaaaagagaccaccggaaatgaatctgcaaaagatgcttcattatttactatttttggggtgggagagacaataaacgttttaatggtaaaaa

SEQ ID NO: 2484 - DNA, 1896 bp, Rattus norvegicus
  Genbank Accession No. NM_057153
ttttgaaaacagttcttccgtgatttgctgaagcttaatgtgacctgggaaggaaatgtcccgtctctggtatgggaaaaaagggagaagacatcagcaagttaatcataaatacactctgatcaccacacgggaggacatcaactcaaagcaggctgctccagcaaaagcagacctggagccagaatctttccgaccaaacctaagtgaccccagtgaactcttactgcctgatcagatcgaaaagcttactaagcaccttccaccgagaaccattggctacccatggactcttgtgtacggtactgggaagcatggcaccagtttgaagaccctttaccgaacaatgacaggtctagacactccggtgctgatggtgattaaagacagtgatgggcaggtttttggtgcattagcatcagagccgtttaaagtaagtgatggcttttacggtactggagaaacatttgtttttacattctgtccagaatttgaggtcttcaagtggacaggagataatatgttttttatcaaaggagacatggattcgttagcgtttggtggtggaggaggagaatttgctctttggcttgacggagatctctaccatggaagaagccattcctgtaaaacgtttgggaatcatacactgtctaagaaggaagacttcttcatccaagacattgaaatctgggcttttgaatgaatacagtgcthttggttgtagcaggacatcagcccaaacctgaatggacaaacgcatcgtttggaatgttcaagaagcaatacaattaatgtcacttgtgctttaaagtcagtctgtttggccatttactgcaactataattttggagtttatttttcaaatcatgtttctgtcccagagttcttttgtttacaccatggcctgggttccagtagtttaacagccaggtgggatctgtcagcccagtgtagcacttggatcacaaaggccaccaccttttcagttgatgtcatctcagtcctaactggatggtgctctgttcaactttttttaacctgtgttaattctttttatagagcagtgtacttggggcattgaggaaatggggcctagatacttctgtatctggtgaagctgacacaggtaacaattgggcctacttacattttcgtctaaatgagaaacyacatgccaaaataacacatgcttcatagacctcttctagttctaattcactgcagcattctcttattcattttgtaagcattctcgatttcatttgaagacagtgaaattggaggagcagtctgattggcatagacagcagcacacacagtcggcaggtttgggcgcatgttttcatcactgaattttcagatagagttacaaattgacagaggagaatgggaattcaatgattctattggatttaatatattaagcaagtaatactatttacatatttgtagcttaatagrgcattatcataagtacaaaactaaaacttgcatatttcttcaacattgtgtcatatacactgttttacagttctcttgttttagcctcgttgcataccaactcccccaatacattttagttttgttttgttttctgctcaaaaggaagcaaattgttttgaaataaaaacgtgtttttttctaagtggtatatgttattagttaccattagcatctgctcttaccggagggcagtgactatcgtagacaatactgtaactcagtagacttggcgaatgtgcaagcttactgtcaagtggcctccaaaatgaaaagatagaataaactagcacttgtattctttcttgtaggaaaccaacaataagccatgtggcaacaattcatcaattaaatttcagagcttcatgtaatgcaaaaaaaaaaaaaaaaaaa

SEQ ID NO: 2485 - DNA, 2316 bp, Rattus norvegicus
  Genbank Accession No. NM_057191
atggattcccagcgggagcttgcagaggaactccggctttaccaatccacccttcttcaggatggtctaaaagatctcctggaagagaaaaaattcatcgattgtaccctaaaagcaggtgacaaaagttttccttgccacagactgatattgtcggcttgtagcccttacttccgtgagtatttcttatctgaaattgaggaggagaagaaaaaggagatggcgctagacaatgtagatcctgctatacttgatttgatcatcaaatacctgtactctgccagtattgatctcaatgacgggaacgtgcaagacatcttcgccctgtccagccgcttccagattccgtcggtgttcaccgtctgtgtgtcttaccttcagaaaagactggctcctggtaactgtctggccatcctaagattggggcttcttctcgactgtccaagacttgccatttctgcccgggagtttgtgtcagatcgctttgtgcagatttgtaaggaagaagacttcatgcaactgtccccacaggagctgatctctgtcatttcaaatgacagcctcaatgtagaaaaggaggaagtggtatttgaggccgtgatgaaatgggtacggacagacaaagaaaacagggcgaaaaatcttagtgaagtatttgactgtattcgttttcgccttatggctgagaaatatttcaaagatcatgtcgagaaggatgacataattaaaagcaacccagaagtccagaaaaaaatcaaagttctaaaggacgcttttgcaggcaaacttccggaacccagcaaaagcgcagagaaaggggggacgggcgaggtgaacggtgatgttggtgatgaagacttacttcctggttacctgaatgatatccccaggcatggaatgttcgtcaaagatctcatcctcttggtcaatgacacagctgcagtggcgtatgaccccatggaaaatgagtgttatcttactgccctagctgagcagatccccagaaatcattccagtattgttacccaacagaaccaggtctacgtggtcggaggactgtacgtggacgaagagaataaagatcaacccctgcaatcctactttttccagcttgataacgtatcatctgagtgggttggactaccgcctctcccgtcagccaggtgcctctttggtctgggagaggtagatgacaaaatctatgtggtcgccggcaaagaccttcagacagaggcctccctggattccgtgttatgctatgatcctgtggctgcaaagtggagcgaagtgaaaaatcttcctattaaagtttatgggcataatgtgatctcacataatgggatgatatactgtctgggcggaaagacagatgacaaaaagtgtacgaatagggtgtttatctacaaccccaagaaaggagactggaaggatctggctccaatgaaaaccccacgttccatgtttggagtggcaatccacaaaggcaaaatcgtgatcgcaggaggcgtcactgaagatggcctttcagcttcagttgaagccttcgacctcaaaaccaataagtgggaagtgatgacggaatttccccaagaaagaagctccatcagcctggtgagcctggccggatccctgtacgccatcggcggctttgcgatgattcagttggaatctaaagagttcgcgcccactgaagtcaatgacatatggaagtatgaagatgataaaaaagaatgggctgggatgctgaaggagattcgatatgcttcgggagctagttgcctagcaacacgcttaaatctgtttaaactgtctaaactataaaggaggtgacaaagacacggtttgagaggtggcttgttgggacaagagggccttaatgtattgtccttctttaagcctatacaatgattcatgtagggtaacattgatctgtgcagttccccgggagataaaacagtgtaaccgaatccccaaggtgttttagcgtgtggagtataaaaccgtttgctagggagttagtatacagttgaacaatgtattttgtcaaacctttctcatagaagcgagctttctacatcctgatgtttactaatcctttgtattcttaaggtacatttacacttgttttctattataaatgaaatgcatatgtctacactctcaagagatgtttgagtaacagaaacctctccccggttttgagctacgacaggaatcttgtgcattttaatgaagatgactggaagtgctgtataagaagtgtaataaaggagtgtccagtcccttccccattaaaaaaaaaaaaaaaaaaaactc

SEQ ID NO: 2486 - DNA, 1109 bp, Rattus norvegicus
  Genbank Accession No. NM_057197
gaattccctgctgcaaacatggcgctgctggcccgtgcgttctttgctggggtgtcccgcctcccctgcgatcccggtcctcagaagtttttcagctttggaacgaaaaccctgtatcaaagcatcgatgctccacagtctaaattcttcccacccattttaaagcctatgctaccacctaatgcctttcaaggaaaagtggctttcatcacgggaggaggcactggccttggcaaggcaatgacaactttccgctccagcctgggtgcccagtgtgtgatcgcgagcaggaatattgatgttctgaaagctactgcagaagagattacttctaaaactggaaataaggtctatgcgattcggtgtgacgttcgagatcctgatatggtacacaacacagtactggagctgatcaaagttgcagggcatcctgatgtggtgataaacaatgcggcagggaacttcatttctcccagtgagagactgtctcccaatggttggaggaccataactgacatagttctcaatggtacagcctatgtgacgatagaaattggaaagcagctaattaaagcacagaaaggagtcgcctttcttgctatcactacgatctatgctgagagcggatcaggctttgtaatgccaagttcttcagccaaatcaggcgtggaagccatgaataagtctcttgcagctgaatggggtagatacggaatgcgtttcaacataattcagccagggcctatcaaaaccaaaggtgcctttagccgtttggacccgactggaaaatttgagaaagatatgatcgagagaatcccctgtggtcggctgggaactgtggaggaacttgccaatctagcgactttcctttgcagtgattatgcctcttggatcaatggggcagtcattcgatttgacggtggagaggaagtgtttctgtcaggtgaattcaactctctaaagaaggtcaccaaggaggagtgggatgtaatcgaaggcctcatcagaaagacaaaaggctcctaagacgttcatggcttcctctgtgacaaactaaagtttagggactatatagatggacatttgagttaataaattttttgtctgat

SEQ ID NO: 2487 - DNA, 1101 bp, Rattus norvegicus
  Genbank Accession No. NM_057208
agcagctgggtaggcaccatggccgggagcaccaccatcgaggcggtaaagcgcaagatccaggttctgcagcagcaggctgatgatgcggaggagagggctgagcgcctccagcgggaagtggagggagaaaggcgggcccgggagcaggctgaagctgaggtggcttccttgaaccgtaggatccagctggttgaagaggagctggaccgcgcccaggagcgccttgccactgctttgcagaagctggaggaagcggagaaggctgctgatgagagtgagagaggtatgaaggtgattgaaaaccgggctctaaaagatgaagaaaagatggagctccaggaaatccagctgaaggaagcaaagcacattgcagaagaggcagacaggaagtatgaagaggtggctcgtaagttggtgatcattgaaggagacttggaacgcacggaggaacgcgccgagctggcagagtctaagtgttctgagctggaggaggagctgaagaatgtcaccaacaacctcaaatctcttgaggctcaggcggagaagtactctcaaaaagaagacaagtatgaagaagaaataaagattcttactgataaactcaaggaggcggagacccgggctgagtttgctgaaagatcggtagccaagctggaaaagaccattgatgacttggaagatgagctctatgcccagaaactgaagtacaaggccattagcgacgagctggaccacgccctcaatgacatgacctctatataaactgacaccgtttctgctctgtcctggatctacccccctttcaggggtaattgatatgatataaggggcctaggaatacaattgatgttagggcgtttattagaataatgttggtgtactcggctatgaagaatagggcgaatggtcctgcggcgtattcgacgttaaagcctgagactaattctgattctccttctgttaagtcgaagggagctcgatttgtttctgctagggttgaaatgtatcatattatggctattggtcaggcggggattaatagtcagatatgttcttgtgcacttataagtatttctagggagaaggagccgcttatta

SEQ ID NO: 2488 - DNA, 3844 bp, Rattus norvegicus
  Genbank Accession No. NM_057210
cctcagccctgtggctggaccccctccctcacccggggactccctgacccggggaaccaagctcaggtctccagagcctcccagaagaaaaataggcagccctccctgaaatatcttggctcctcagtttatcctttccaacctggctcccccttcccagttcccctccctactccctgtctccctccccaactcaccctactgaactgggtgcagagcaaagcccttttcgcccttttccccatctggacttctctggccagttcctcttagtccgatcccaaagacactggaacacatttctaaagggtcttcttgatccctccaattcattgagcaaagggctgaaaaagaagcagagagtaaggtagagccagtgactcgcccccaagccccatcatggaagaaggctttcgagaccgagcagcgttcatccgtggggccaaagacattgccaaggaagttaagaagcacgcggccaagaaggtggtgaagggtctcgacagagtccaggatgaatattcccgaaggtcctactcccgctttgaggaggaggaggatgatgatgacttccctgcccctgctgacggctattaccgcggagaaggggcccaggatgaggaggaaggtggcgcttccagtgatgccactgagggccacgatgaggatgatgagatctacgagggagaatatcagggcatcccccgggcagagtctgggggcaaaggcgaacggatggcagatggggcacccctggctggagtgagagggggcttaagtgatggggagggtccccctgggggtcgcggggaggcgcagcggcgtaaagatcgggaagaattggctcagcagtatgagaccatcctccgggagtgcggccatggtcgcttccagtggacactctacttcgtgctgggtctggcgctgatggccgatggtgtagaggtctttgtggtgggctttgtgctgcccagtgctgagaaagatatgtgcctgtcggactccaacaaaggcatgctaggcctcattgtgtacctgggcatgatggtgggggccttcctctggggaggcctggctgatcggctgggtcggagacagtgtctgctcatctcgctctcagtcaacagcgtcttcgctttcttctcatccttcgtccagggttatggcaccttccttttctgccgcctcctttctggggttgggattggtggttccatccccattgtcttctcctatttttcggagtttctggcccaggagaaacgtggggagcatttgagctggctctgtatgttctggatgattggtggcgtgtatgcagctgcaatggcctgggccatcatcccccactatgggtggagtttccagatgggctctgcttaccagttccacagctggagggtctttgtcctcgtctttgcctttccctctgtgtttgccatcggggctctgactacgcagccggagagtccccgcttcttcttagagaatgggaagcacgatgaggcctggatggtgctgaagcaggttcatgacaccaacatgcgagccaagggccatcctgagcgagtcttctcagtaacccacattaaaacgattcatcaggaggatgaattgattgagatccagtcagacacaggaacctggtaccagcgctggggagtgcgggctttgagcctggggggtcaggtttgggggaacttcctctcctgcttcagtccagagtaccggcgcatcactctgatgatgatgggggtatggttcaccatgtccttcagctactacggtttgactgtctggtttcccgacatgatccgccatctccaggctgtggactatgcagcccgaaccaaagtgttcccaggggagcgcgtggagcacgtgacatttaacttcacactggagaatcagatccaccgagggggacagtacttcaatgacaagttcatcgggctgcgtctgaagtcagtgtcctttgaggattccctgtttgaggaatgttactttgaagatgtcacatccagcaacacattcttccgcaactgcacattcatcaacaccgtgttctacaacacggacctgtttgagtacaagttcgtgaacagccgcctggtgaacagcacattcctgcacaataaggaaggttgcccactagatgtgacagggacgggcgaaggtgcctacatggtgtactttgtcagcttcttggggacactggctgtgctccctggaaatattgtgtctgctctgctcatggacaagattggcaggctcagaatgcttgctggttccagtgtgttgtcctgtgtttcctgcttcttcctgtcttttgggaacagtgagtcagccatgatcgctctgctctgcctttttgggggagtcagtattgcatcctggaacgcgctggacgtgctgactgttgaactctacccttccgacaagaggacgacggccttcggcttcctgaatgccctgtgtaagctggcagctgtactgggcatcagcatcttcacgtcctttgtgggaatcaccaaggccgctcccatcctcttcgcctcagctgcgcttgcccttggtagctctctggctctgaagctgcctgagacccggggacaggtgctgcagtgagggatgggggagtgtctcaggggctttagggatggcaggcacactgtgaccaataatttcttttatccctaccctgccctgctgtcctggtcctactccgtgtttggtgtcttagctgtgtgcctgtgtgcatgtgtgtgaccctgacgggcaggggctacggggagggtccctttgtcccatgtttgggaggagggactccccacctgctgccaccctcaactttgcacaaggagaaggctgagctgcatccttctctccctcagtgttagcaggggtggggacgactgtttctctgctccaggtgttccagaatttctgcctttcccatcattccctccgcctaggccctggtgaaccacaggtatggagttatagtgggggctgaggcttggaccaaaagaacttcttgagtgggagcctcccaaggatgctggggagtagcaataaaccttagcctccgttttcacctcaattcaggctacaagtgtgaagcctggattttatggaattagttttctgattcttatttatatgtaagttctgaggcagcttagctggactgtgtgtggatgtatacatacactcatatgtgtgtgtgtgtgcgccgcgtgcgtgtgcgtgtgtgtatgtgtgccatggggtaggggtaccactatactgttcaattataagccaagagtagtagtttcagtgagcacacacacaacactgtttttctatcgtaactcccagaatcttgtacctgtgttggggctgcaggcagaagtccttggtcaggctggggtgagccctgcaatcttgggggacctgagggcacctgacaaggactttctccttcctctagagaggttctacccactagccacagccctcccatctgacctgtccacacaggcagtgtatcagaggaaagaaagggaaaataaccaggcacacatggtcaaaccagcaggtctgaaagcacaagaagctggggcaggggcaggaagcaggggtccatcccctaacccttctcaaaaaggctgggtcgtgagggacccctaatgcagggacctgaagcctcagtttccccatcttgcccttccacagaacagcctctgtaggtagagctgccccccgtcctaccctactcttgtggctgctttctttggtactcttcccactcccaccgtagctgtgacgtgttgtagtttttagctgtttgtaaaatgtt

SEQ ID NO: 2489 - DNA, 2721 bp, Rattus norvegicus
  Genbank Accession No. NM_057211
gcggccgtcggcggacgcgggaagaagtgtcttgtaggcgcggcgccccactcagccccggcccccctcatccgcgtactcggctgatgcctcagggcgtcagctcggcggagaggcggtcgaggcgtgcgcctggctagcagttggctttccccgtgactcggacacgtttgcagtcgaataaacttgcgaccgccacgtgtggcatctctccaaggaaccggctcaggaggagggcgcgcccatcgtgggatcgcgcggggcgcccggcagggcggcggcgacagcggcagagccggccgcggctgctgcgtgcggaggcgctgccggttacgtaaagatgaggggctgaggtcgcctcggcgctcccgcgagtcgcaagctcccgcgcccccgccccctcggccgcgccgcaccgcgctcgtcgtccgagaccagggcagggctagccgaagctccgcagccaccctcaagtttggccgcaccgcccgggctgccgtcgcccgcaccatgtccgcggccgcctacatggacttcgtggctgcccagtgtctggtttccatctccaaccgcgccgctgtgccggagcacgggggcgctccggacgccgagcgactgcgactacctgagcgcgaggtgaccaaggaacacggtgacccgggggacacctggaaggattattgcacactggtcaccatcgccaagagcttgttggacctgaacaaataccgacccatccagaccccctcggtgtgcagcgacagtctggagagtcccgatgaggatataggatccgacagcgacgtgaccaccgaatctgggtcgagtccttcccacagcccggaggagagacaggattctggcagcgcgcccagcccgctctccctcctccactctggagtggcttcgaaggggaaacacgcctccgaaaagaggcacaagtgcccctacagtggctgtgggaaagtctatggaaaatcctcccatcttaaagcccattacagagtgcatacaggtgaacggcccttcccctgcacgtggccagactgccttaaaaagttctcgcgctcggacgagctgacccgccactaccggacccacactggcgagaagcagttccgctgtccgctgtgtgagaagagattcatgaggagtgaccacctcaccaagcatgcccggcgccacaccgacttccaccccagcatgatcaagagatcaaaaaaggctcttgccagccccttgtgaggtgctccccatatggcaaccaggcagagatggtcccggaaggacagagctcccaggaaacagacggacacatggaaatctgccaccgcagagttgtgctggccacaggaggtcactgctctttggtcaatattctgacactctccctgcgctgtttccaaaaagcacacggtagcctaagatcaaagtcaacatttggtccccttgcagaggccactctgaaccgtctctgactgttggagggcaggcaaataaatgcttttggtattttctcctttgttttggggggtggggggagggggcaaggccaagacttggggtaggatttttgaagattcaggctggtgtacatacgtctgactgggtgagttgacccctggcctcccacagtgactctggatccttgatgcttgctgactctcagaattgtttttcttctctctcaatgtcacgaccagagtgcttcagcttgtttagcagagccactctcgaatcacgttaacttttgagatttaaaaaacaaaacaaaacaacaaaaaaaaaaaaaaacccctccatagcacagctgtcttttatgcaagcaagagcacacctactccagcatgatctgtcatctaaggacttcaaaacaaaacaaaacaaaaaaaaaagttacttatagtcagtggataagcagagtccgaatttacactaaacaagacagaccttcgaggggtcataagtccggaactttcaaaccttgcttcgtatgaatcgtactatctgaacataaactgcacttttattttctaataccgagggtgaatacggtaaatccatgccttgagggtagaagccgacattctgtttggcacacgttattatctgcttattttccaggatacacatttccctgagaacccacggcagagatgtgagggcagaatgtatggaaacacatgctgaggaggggaaggaggaggggagtgctttaaagatacaaaaaaaaaaaaaaaaaaaaaaagagcaaacaattttaacttcatgaatttgtttgaattttcccaagcttcagataacaacgccactcacgggactaggacgctgcaagagcattgggctctgtgtagcattagctgataaatgggtgtatagccatcaccagacctggaaatgcccccttttggtgggggtgggggtgtttcttggtctctctttcgttcctatgaaatttccactaagaggtgcaagagttatatcaaaggaaagggaactgaaatatggaaaaaaaaaagtttgcccctgtaagtagtctctagggaaggaagatgccacaatggtttcagaggcgactctgcagaacagtcccttctgctgaacataggtcagagaaacactcgtgaatggcatcacatcgccaactgtctgcatcatggcccaccactacttagcttgtatctcggtgtctacacaatggcctgaaccactggtcaccat

SEQ ID NO: 2490 - DNA, 999 bp, Rattus norvegicus
  Genbank Accession No. NM_057212
tgagccagtgtcgtcccaacacgctggcagcaacaagcctcggccttccaggccccgcggttccctcgccggacggtcgccagcgcgccatgcagcctccgcccgccccgcgcgcgtaggcgctcgccacaggccatgctaccccttctcgccgcgctactggccgccgcctgcccgctgccgccggcgcgcggcggggccacggatgcgcccggcctttctgggacgcccccaaatgcttcggccaatgcttccttcaccggcgaacactccaccccgcgtctgctggcatcggcggcatccgcacccccagagcgcgcgggcccagaggaggctcctgcggcgccctgcaacatcagcgtgcaacggcagatgctgagctccctgctcgtgcgctggggccgcccgcggggcttgcagtgcgacctgctgctcttctctaccaacgcgcacggccgcgccttctttgccgccgccttccaccgcgtcgggccgccgctgctcatcgagcatctggggctggcggccggcggcgcgcagcaagacctgcgcctgtgcgtgggctgtggctgggtgcgcggccgcctgcgagctcccgccggggctcccaccgctctgcctgcctaccccgcggccgaaccggggccgctgtggctgcagggcgagcctcgtcacttctgctgcctggacttcagcctggaggagctgcagggcgagccgggctggcggctgaaccgcaagcccatcgagtccacgctggtggcctgcttcatgacccttgtcatcgtggtgtggagcgtggccgccctcatctggccggtgcccatcattgccggcttcttgcccaacggcatggagcagcgccggaccaccgccggcgcccccgcggccgctcctgcagccgtacccgcggggactaccgccgcagccgccgccgctgctgcagcagctgccgcggccgcggccgtcacctcgggggtggctcccaaatgacccccg

SEQ ID NO: 2491 - DNA, 918 bp, Rattus norvegicus
  Genbank Accession No. NM_058208
gcgatctgtgggtgacagtgtctgcgagagactttgccataccattttgcgggaatttggagagaaacaaccagctgcttccagtcccctccccctccgccaccatttcggacaccccgcacagactcgttttggggtaccctgtgacttccaggaagcacgcgaggtcctttggccccagctcgggcgaccacctgtcttggacgtgttgactcatctcccatgaccctgcggtgcctggagccctctgggaatggcgcggacaggacacggagccagtgggggacagcggggtcgccggaggatcagtccccggaggcggcgcgtctggcgaaggccctgcgtgagctcagtcaaacaggatggtactggggaagtatgactgttaatgaagccaaagagaaattaaaagaggcgccagaaggaactttcttgattagagatagctcccactcagactacctattaaccatatctgttaagacatcagccgggccgactaacctgcggattgagtaccaagacgggaaattcagattggattctatcatatgtgtcaagtccaagcttaagcagtttgacagcgtggttcatctgattgactactacgttcagatgtgcaaggacaaacggacaggccctgaagccccccggaatgggactgttcacctttacctgaccaaacctctgtatacatcagcaccgacgctgcagcacttctgccgactcagcattaacaagtgtaccggtaccatccggggactacctttaccaacaagactgaaagattacttggaagagtataaattccaggtataagtatttctctctctctctctctttttttttttttttaaatgaatgcctcatatagagtatcaccgaatgcagctatgtgaaagagaaccagaggccctc

SEQ ID NO: 2492 - DNA, 432 bp, Rattus norvegicus
  Genbank Accession No. NM_078617
atgggtaagtgtcgtggtctccgtactgcccggaagctccgcagtcaccgacgggaccagaagtggcatgataagcagtacaagaaagcccacttgggcacagccctgaaggccaatccgtttgggggtgcctctcacgcaaagggaattgtgctggaaaaagtaggggttgaagccaaacagccaaattctgccatccggaagtgtgtcagggtgcagctcattaagaacggcaagaagatcacagcgttcgtgcccaatgacggttgcttgaacttcattgaggaaaatgatgaagttctggttgctggatttggtcgcaaaggccatgccgtgggtgatattcctggagtccgctttaaggtggttaaagtagccaatgtgtctcttttggctctgtacaaaggcaagaaggaaagaccaagatcataa

SEQ ID NO: 2493 - DNA, 1107 bp, Rattus norvegicus
  Genbank Accession No. NM_080399
aaggcatttcaacatcaatattattctattagtccagtagatagtagctaagtttcaaattctgtgttaatcaaaatttaaaaatatgattaagtcatattaggattacaacaaagagatgtaatctttaaagtctaccaatacatttaaatgagcagtatacagtatgtactaaataccatgccaggaaatggagaaaatgtactgtatttatagagtatattgaaaagttctgggagaaatttagatatgagctctatcttcgcacatttcagaaaataaggttaacagcaaacaggtattgctgtttatagataatctatgactgtaaagtttgtatggatttagaaattaaattagccttcagcgtctggtgaaatcccgcagcgtctagggaaagatccgttctgctccgcgagggaaacagagccgttgaccatggttgcaacgggcagtttgagcagtaagaacacggccagcatttcagagttgctggacggtggctctcaccctgggagtctgctaagtgatttcgactactgggattatgtcgtccctgagcccaacctcaacgaggtggtgtttgaagagacaacatgccagaatttggttaaaatgttggagaactgtctgtccaagtcaaagcaaaccaaactcggttgctctaaggtcctggttcctgagaaactgacccagagaattgcccaagatgtcctgcggctctcatccacagagccctgcggccttcggggctgtgttatgcacgtgaacttggaaattgaaaatgtgtgtaaaaagctggataggattgtgtgtgatgctagtgtggtgccgacctttgagctcacgctggtgttcaagcaggagagctgctcctggaccagcctcaaggacttcttctttagcggaggtcgcttctcgtcgggccttaggcgaactctgatcctcagctcgggatttcgacttgttaagaaaaaactgtactctctgattggaacgacagtcattgaggagtgctgaggaggaaaaaacaattaaaggtccctaatgagtggctaataaacctctggagctatccagcaaaaaaaaaaaaaaaaaaaaaaaaaa

SEQ ID NO: 2494 - DNA, 1993 bp, Rattus norvegicus
  Genbank Accession No. NM_080479
tgagacatgtctgacacaagcgagagtggtgcagatccagctcgctctcagggcaaagcttcagaaaaggacggcggctccatgatgcaggacctgttgactgtgacccagaacttggaggtctcagagacaccaaaggctgaaaaggcaccagaggtctcagaagctgcaaaggtccccaaagcctctgggaacccaaaggcgacagaggtctcaaaggccccagaggcttcggaggcagctgccacccaggcctcacctaccacacagctgagtgagacccaggttctggcagctgaaaacaagagtccagcagctgacaccaagacacagaaggctgacctgcaggctatgacaatacctgcaacccagaccaaaacggtcagttctgttaccgattctaaggtcaatacaaagactccggagaccgaggctcctgcctctcagtctggggcagatgaaccagagcctgagggtgcagctgtccaagttcaggagaatcaggatactcggcccaaggtcaaagccaagaataccgaaaaggggaaacacctggaaggggaagaggacggcaacagtgatcagagtcagactccagaaaccacaggtggtcggagggtctcaaaggccctaatggcctccatggcccgtagagcttcaaggggacccatagcgttctgggcccgcagggcatcaaggactcggttggctgcctgggctcggagagctttgctctccctgaggtcacctagagctcggagaggcaaggcccgaagaagagctgccaagctgcagtcatcccaggaacccgaagcacccccacccagagatgtggcccttttacaaggaagggcaaatgatttggtgaagtacctgttggctaaagatcagacaaagattcccatcaggcgctcagatatgctgaaggacatcatcaaagaatatacggatgtataccctgaaatcattgaacgagcaggctattccttggagaaggtatttggaatccaactgaaagaaattgacaagaatgaccacttgtatattcttctcagtaccttagagccaactgatgcaggcatcctgggaacgaccaaggactcacctaagctgggcctcctcatggtgcttcttagcatcatcttcatgaatggaaatcggtccagtgaggctgtcatctgggaggtgctgcgcaagttggggctgcgccctgggatacatcactcactctttggggatgtgaagaagctcattactgatgagtttgtgaagcagaagtacctggactacgctagagtacccaatagcaatcctcctgagtatgagttcttctggggcctacgctcttactacgagaccagcaagatgaaagttctcaagtttgcctgcaaggtgcaaaagaaagatcccaaagaatgggcagctcagtaccgagaggcaatggaagcagatttgaaggctgcggctgaggctgctgccgaagccaaggcgagggctgagattagagctcagatgggcattgggcttggctctgagaatgctactgggccctgcaactgggatgaagctgatattggaccctgggcaaaggcccggatccaggcgggagctgaaactaaagccaaagcccaagaaagtagtggtgccagtgctggtactggtgccggtgccagtgccagtgctggtaccagtgtcagtaccagtggcactgctggttctggtgctaatgctggggccagtgggggcttcagtaccaaccccagtctgactgccagtctcacgtttgggctcttcgctggccttagtggagctggggccagtaacagtagcagctctggtgcctgtggtttctcctacaagtgagatacagattgctaatcacagcgtcttcttctcaagccagggtgcactctcagacacttattcaatgcagcactctaggcaaccgctatcaatcaattgaagtcgacactctatattaaatctatttgcc

SEQ ID NO: 2495 - DNA, 5413 bp, Rattus norvegicus
  Genbank Accession No. NM_080583
aaattggttttgcgcagtgtcttagatctagagagaatcgagacgggcaggaaaccattacaccaccttcccggctgtgctctctgactccgccgccaccccgcccttgcctccggttcacgctgaagatccgagaatcatgactgactccaagtacttcacaaccaataagaagggagaaatctttgaattaaaagctgaactcaacaatgaaaagaaagaaaagaggaaggaggctgtgaagaaagtgattgctgctatgaccgtggggaaggatgtgagctctctcttcccagatgtggtgaactgtatgcagactgacaacctggaactaaagaagcttgtgtacctctatctgatgaactatgccaagagtcagccagacatggccatcatggctgtcaacagctttgtgaaggattgtgaagaccccaatcctttgattcgagccttggcagttagaaccatgggatgcatccgggtggacaagattacagagtatctctgtgaacccctccgcaagtgcttgaaggatgaagacccctatgttcggaaaacagcagcagtatgcgtggcaaaactccatgatatcaatgcccagatggtggaagatcagggatttctggattctctgcgggatctcatagcagattcaaacccaatggtggtggctaatgctgtagcagcattgtctgagatcagtgagtctcacccaaacagcaacttacttgatctgaaccctcagaatatcaataagctgctcacagccctgaatgagtgcactgagtggggccagattttcatcttggactgcctgtctaattacaaccctaaagatgaccgggaagctcagagcatctgtgagcgagtgacgcctcggctctctcatgccaattctgcagtggtgctttcagcagtaaaagttctgatgaagtttctagagttgttacccaaggactctgactactacaatatgctgctaaagaagctagcgcctccacttgtcactttgctctctggggagccagaagtgcagtatgttgccctgaggaacatcaacctaattgtccagaaaaggcctgaaatcttgaagcaggaaatcaaggtcttctttgtgaagtacaatgatcctatctatgttaaactagagaagttagacatcatgattcgtcttgcatcccaagccaacattgctcaggttctggcagaactgaaggaatatgccactgaagttgatgtggactttgttcgcaaagctgtgagggccattggacggtgtgccatcaaagtggagcaatcagcagaacgctgtgtgagcacactgcttgatctaatccagaccaaagtaaattatgtggtccaagaggcaattgttgtcatcagggacatcttccgaaaataccccaacaagtatgagagcattatcgccacgctgtgtgagaacttggactccctggatgaacccgatgcccgagcggctatgatttggattgtaggagagtatgctgaaagaatcgataatgccgatgagttactagagagcttcctggaaggttttcatgatgaaagcacccaggtgcagctcacgttgcttaccgccatagtgaaactgtttctcaagaagccatcagaaacacaggagctggtccaacaggtcttgagcttggccacacaggattctgataatcctgaccttcgagatcggggttatatttattggcgccttctttcaactgaccctgtgacagccaaagaagtagtgttgtctgagaagccattgatctctgaggaaacagacctcattgaacctaccctcctggatgagctcatctgccacattggttctttggcctccgtgtaccataaacctccgaatgcttttgtggaagggagccatggcattcatcgcaaacacttgccaattcaccatgggagcactgatgcaggtgatagccctgttggcaccaccactgcaaccaacctggaacagcctcaggtcatcccctctcaaggtgaccttctgggggatcttttaaatcttgacctgggtcccccagtgaatgtcccgcaagtgtcctccatgcagatgggagcagtggatcttttaggaggaggactggatagcctgcttggcagtgaccttggcgggggcattggaggaagtccggcagtaggacagtccttcatcccgtcatcagtgcctgcaaccttcgctccttcacctactcctgctgtggtcagcagtggtctgaatgacctgtttgagctttccactgggataggcatggcacctggcggatatgtggctcctaaggcagtctggctacctgctgtaaaggctaaaggcttggagatttcggggacgtttactcaccgccaagggcacatctatatggaaatgaacttcaccaacaaagctctgcagcacatgacggattttgccatccagtttaacaagaatagcttcggtgtcatcccgagcactcccttggccatacatactccgctgatgccaaaccagagcattgatgtgtctctgcctctcaacaccttgggcccagtcatgaagatggagcctctgaataacttgcaggtggctgttaaaaacaatattgatgtcttctacttcagctgcctcatcccactcaatgtgctttttgtagaagatggcaaaatggaacgccaggtcttccttgcgacgtggaaggatattcccaatgaaaatgagctccaatttcagattaaggagtgtcatttaaacgctgacacagtttccagcaagttgcaaaacaacaatgtttacactatcgccaagaggaatgtggaggggcaggacatgctgtaccagtccctgaagctcactaatggcatttggattttggcagagctgcggatccagccaggaaaccccaattatacgctgtcgctgaagtgtagagcccctgaagtctctcagtacatctatcaggtctacgacagcattttgaaaaactaataaatgggtccagtcagcctgtaatcagtgcaagccacgaactcttaactgaaagacattgtattgttgtgtagagcctgaacccaaaccctgcggtacccaccccggtagtggccagtcattttgtgctgatattagcactcaccccattggtaggttagcttcccgtgacatctccttccactatcgcccccctctgccacctgccgctgctctctgtccttagttgtgagttcctctgtgctgtgccaatggctagccttttctacaccctcttttgagtgtagtttgatattttgtaatcgaaagctcatttcacaagcagaaaaaggcaacaagttaattagagcgaggaagagtgtcactgaaacatacactgcaccttattgttttatatttttgtacagatgagatagatattgaggtagaacgctgagtagaaagggtgactgaccctcctcagacacagtcttattggagacatatggccctggccccttctggggcaaggagaggcgaccccactcctggtcttttgcattttcaccttggccacgccttccagctctcttatgcccatgctctctcatttggcgaccacattgatgtttctgagtgcagggacactggacatgtgagcacagtgctgagagatggcagagctgtgctcgtgtctacagcgctagcccaggagtcaccctgaggaggctgggtagacatgagtaagaacacagcgccctcccctagcctccttccctgtttttcagggctagttcagatttaaagtcagtgtttgagagttaagacagactttagtgacttccccaaccctgtttttctacaaagaaaggtgataggggagaagggtgctgccaaggtggcctcttggctcttgagtagcagagctgagactggtcccgacctccatcagcttccctatgtggccgccctcattattctttccttaaagcctctgccggtcctgtgcctcctgtggctctttgacactccatactgagtttggagctccaccgattccctggcgtccggtggcagctggcgtctcagttacatgagtttgcatccaggtaacaagagtgaaagcggagctgacattcgccaggactgtcctggagccacagttcggaggctggccagtgagcagtgagtatagaagtgtgtagaggtgttgccaattctcactgtccctcacctcactgatctgccctccattggtactcaagctccaaagcacaggaagatcattccagaaggctgtgtagttcttgtcatctcacagaggactggggatgggaagtgcctctcgctaaggaattggtatgaggcatcgaagaaagcctcatactgtcaccctgcttgagatgtggcacttgttgcacagcctggcacctggtattcagggtccattcagagtcctatgctcaaggcagaagcatgccagggtccaaagacctcatgtaggactcagacctgacccactggatcccgaggagaaactggaaaaatcagggtagaaaccagcttcttttaaaagtgtgtctggagtgatcctatttcctcccaaagtctttaagaggattgctggctggcaaaaaagaaataacatccctctctcactctctcactctctcactcactcactcactcactcactcactcactcaccatgtggggagtaagaaatactgcagggttgtgtgggaggcaggtggtatattgggtggaaagcaagttgaccaagttcccttgtcggtgccgattcctggagtcagttggatgtgagtggtgtaagggattcccactacagacagtgttctcatctcaaagcaaattcccaaaagtacatgtgtcagggcaagcagaaaattttataccagaacatgtccaccccagaaactaaggcctctatcagcccctctaccagtgacagataccagctgtggttctctgctggcctgagcccatccatggtgtctagctccctcttgtttttaccccaagggagttaggaggaggcaaggagctctcctgaagagactctgttgccttcctgaagcttccccttcaggtcagtttcgagcttgactagattgggagaactggggtcagtttatccgtatctgctctccttggctgaagtgtgtcgctgttgaaagctgaagtacggagggcagggaagcaaacccaccagagctctatctggtcagattccccacgtgtttgttcccagcctggtccctattgtgaagcttgggactgggaccaggtcggagagtaaaagctgtcccaggaatgcgtagtttcctgttctgtcggggtctgttgttggggaggtggggattggggagcctttaccttgtgtattcaccaataaactcatttacacaaaaaaaaaaa

SEQ ID NO: 2496 - DNA, 1739 bp, Rattus norvegicus
  Genbank Accession No. NM_080586
  misc_feature (1)..(1739): n = a or c or g or t
ctatgcacattccttgtactcactgtgctgctgctgaggtgtgaggcaaactccgcttggggactgagctagtggagaaaggatcttaaaagcgacctgatgggttctgggaaagtcttccttttctctccttccctcctgtggagtcaaactagaggagtgaggttgatattcttgttactaaccctgcatctgggaaactgcattgataaagcagatgatgaagatgatgaagatttaactatgaacaaaacatgggtcttggcacctaaaattcatgaaggagatatcacacagattctcaactctttacttcaaggctatgataacaaacttcgtccagatataggcgtgagacccacagtaattgaaactgatgtttatgtaaacagcattggacctgttgatcccataaacatggagtacacgatagacatcatttttgcccagacttggttcgatagccgtttaaagttcaacagcaccatgaaagtccttatgcttaacagcaacatggtgggaaaaatttggatccctgacacgttcttcaggaactcaaggaaatctgatgcgcactggataacaacgcccaatcgcctgctgcggatatggagtgatggaagggttctctacactctgagattaacaattaatgcagaatgctaccttcaactccataactttcctatggatgaacattcctgtccactggaattttcaagctatggataccctaaaaatgaaattgagtacaagtggaaaaagccctcagtggaagtggctgatcctaagtactggagattgtatcagtttgcctttgtagggttaagaaattcaaccgaaatctctcacacaatctccggagattatattatcatgactatcttttttgacctgagcagacggatgggctatttcacaattcagacctacattccgtgcattctaacagttgttctttcctgggtgtctttttggatcaacaaagatgctgtacctgctagaacatccctgggtatcactacggttttgactatgacaaccctcagtacaatcgctagaaaatctttacctaaggtttcttacgtgacagcaatggatctctttgtctctgtgtgtttcatttttgtgtttgcagcactcatggagtatggaaccttgcattattttactagtaacaataaaggaaaaaccaccagagacaggaagctgaaaagcaaaacttcggtatccccaggtctccatgctggatctactctgattcccatgaacaacatttctatgcctcaaggggaagatgattatggttaccagtgcttggagggcaaagactgtgctacctttttctgttgctttgaagactgcagaactgggtcctggagagaagggcgaatacacatacgcattgccaaaatcgactcctactccaggatctttttcccaacagcttttgccttgttcaatctggtttactgggttggatatctatacttataagttctgccaatagataaaaaaattcataaaaatctggcttagtccaatataatcacttcgatttcataacaggaagttagaatttaaaatgaaagtctaccagttaaaatctgaatcatttggtcatatgattaaggctttcataaataaataagaaagaattattcaggttaatttacctaactaaacatgaaattcatgtccaatatagcacatttaaancagtaaacttaataattttt

SEQ ID NO: 2497 - DNA, 510 bp, Rattus norvegicus
  Genbank Accession No. NM_080697
tcggcccggggctgcgggagcagggagataccgcggcggcagcgactgctgctgctggacgagcccaggggacaccgcccctgcccgcgattcgtttcagcccagcgctgctccccaggggcctgtgcggactcgcctgcgtgacgtgtcacaatgtctgaccggaaggcagtgatcaagaacgcagacatgtctgaggacatgcaacaggatgccgttgactgcgccactcaggccatggagaagtacaacatagagaaggacattgctgcctatatcaagaaggaattcgacaagaaatataaccctacctggcattgtatcgtgggccgaaattttggcagctatgtcacacacgagacaaagcacttcatctatttttacttgggtcaagttgcaatcctcctcttcaagtcaggctaggtggccgaggtgaaggtgtcagtggcggcggcagcgatggcaagcaggcggcgttgctgggactgttttgcactggggccagcatca

SEQ ID NO: 2498 - DNA, 2960 bp, Rattus norvegicus
  Genbank Accession No. NM_080698
gaggccaaacagaaggacgtggtcactctgaacggttcaacccaagggacaacatgcagtgggcctccatcctgctgctgcgcgggctctgctcgctttcccagggccagtatgaagaagactctcactggtggctccaatacctccgaaaccagcagtccacctactacgacccctacgacacttacccctacgagacctccgacccttacccctatgaagtagaggagggcccagcctatgcctatggtgccccacctccaccagagccccgtgattgtccccaagaatgcgactgtccccccaacttccccacagccatgtactgtgacaaccgcaacctcaagtacctgccctttgtgccctcccgcatgaagtacgtctacttccagaacaaccagatcgctgccatccaggaaggtgtctttgacaatgccaccggcctcctctggattgctctgcatggcaaccagattaccagtgacaagataggcaggaaggtcttctccaagctgaggcacttggagaggctgtacctggaccacaacaacctgacccggatgcccggaccactgcctcggtccctgagagagctccacctggaccacaaccagatctctcgggtccccaacaacgctctggagggcctggagaacctcacagcattatatctccatcacaatgagatccaagaagtgggaagttccatgaggggcctccggtccctgatcctactagacctgagttataaccaccttcgaagggttcccgacggtctgccctcagccctggagcagctgtacctagaacacaacaacgtctacaccgtccctgacagctacttccggggctcacccaagctgctgtatgtccggctgtctcacaacagtctcactaacaatggccttgctaccaacaccttcaattccagcagccttctggagctagacttgtcctacaaccagctgcagaagatccctcccgtcaacaccaacctggagaatctttacctccaaggcaacaggatcaatgagttctccatcagcagtttctgcacggtggtggacgtcatgaacttctccaagctgcaggtgctacgcctggatgggaacgagatcaagcgcagcgctatgccggtggacgccccactctgcctgcgccttgccagcctcatcgagatctgaggggcttcgccttgggctcggggctccgccttggactccgggctccgccttgggatcggagatcggggctcagggctccgggctccgggctccgggcactggactccgggctccaggcatcgggtaccgggcaccggggtcccggcatatgccctgccacctgctacactcagcttgaaggtctggtttggcttttgctggatggtctgggacaagcacgtgacagaagtccacaggatcttattcagtctccttccgataggcaaagttaggtgggatcaggggccaggccagtttctgcaggggatgaaagtggtggtaaaagaaatggccgcagagtctagcccccaaatcttactatccctcaacccttccccatgacctagtctggcagaccatccccttgcttggataatagcatataaccagacaatctgacttcagctgtgctcactcaatggcttggccagttgcttctgcagtcgctctgggctcctactccttgctcctcaaaacatcaaaacgtacttcctgcccagccacttcctctaggcccagctcatcccctctgccctctttcattgaggcctcttctaaggtcttagacaatcaggagacacccacaccccaaggttggtggggagctgtccaacaacctgtggaggaagaccacacattattatctgaggttaaaaggatatctaaaaccatcacacacacacacacacacacacacacacacacacacacacacaacgtcacctgtttaaagtcagcgtattgaacagtataatggtgactgatagtcatgacttaattacaaggggataaccagccctataatggaggatccatcagaggagagaagggtcaaatgctcatttttaggatccacaataagatggggaagagtcacacctcagaatggcaggactgaaggggcagccccccttccagcttcacctgaccaacatgatctgtgccccttcttgggcttttagtatcaaaggggccagtgtggtttccaaaccatgagaaagagcctctgcccatccttggatccaggtatggaggtttgttacacagaggcagaggcagactgtgccagccgtggacccacccactaacccagacaagggtgtgatctccataactggtttgtccctaaagctagagtttaaggtaccagctcttctggagatggtcactggggtacaggaagccctagccaggcccaaggcttacctacactagacatagtttcctctgcttccacactgtgggaccacaccttatactgatggtgcctgtgacgtgtagcttgtctgagagcaaccctgtcttctcctttttaaaggtgatgttgcctaggtacagccatcgggttctctagactcactgggaaagagccacgggtagccagtggcaagaaccagttgtgagatgttagcctgaggtaggtcccttcccagatgccttagacccatgactctgtgtgcacttaggagcaagcttccctgaaaaggacagggtggggtggggtgcttagactgtgccatgggttccagatcctgaaatccacaaaagccaaaccagcttgtttgaaccagggagtgccacatgtggagcaaggctgccctgcccagagctcttgagaagcacctgcatgcagataccatctggcctctataaagggtcctcagcaagaagcaagcatgagtggtggccaacctgaccaataaagttattttataagtgcaaaaaaaaaaaaaaaaa

SEQ ID NO: 2499 - DNA, 1558 bp, Rattus norvegicus
  Genbank Accession No. NM_080780
caggtctgcagggcagcgggaggaggcggccgccagagtgagctggaggcatgggccaggcggcctggaaggggtttgtgctgtctctgttcgactataagactgcaaagttcgtggtcgccaagagcaagaaggtggggctgctctaccgggtgctgcagctcatcatcctgttgtacttgctcatatgggtgtttctgataaagaagagttatcaggacattgacacttccctgcagagtgctgtggtcaccaaagtcaagggggtggcctatactaacaccacgatgcttggggaacggctctgggatgtagcagactttgtcattccatctcagggggagaacgttttcttcgtggtcaccaacctgatcgtgactcctaaccagcggcagggcatctgcgctgagcgtgaaggcatccctgatggcgagtgttctgaggatgatgactgtcacgctggggagtctgttgtagctgggcacggactgaaaactggccgctgtctccgggtggggaactctacccggggaacctgtgagatctttgcttggtgcccagtggagacaaagtccatgccaacggatccccttctaaaggatgccgaaagcttcaccattttcataaagaacttcattcgcttccccaagttcaacttctccaaagccaatgtactagaaacagacaacaaacatttcctgaaaacctgtcacttcagctccacaaatctctactgtcccatcttccgactggggtctattgtccgctgggcaggggcagacttccaggacatagccctgaagggtggtgtgataggaatctatattgaatgggactgtgaccttgataaagctgcctctaaatgcaacccacactactacttcaaccgcctggacaacaaacacacacactccatctcctctggctacaatttcaggtttgccaggtattaccgtgaccctaatggggtagagttccgtgacctgatgaaagcctacggcatccgctttgatgtgatagttaatggcaaggcaggaaaattcagcatcatccccacagtcatcaacattggttctgggctggcgctcatgggtgctggggctttcttctgcgacctggtacttatctacctcatcaggaagagtgagttttaccgagacaagaagtttgagaaagtgaggggtcagaaggaggatgccaatgttgaggttgaggccaacgagatggagcaggagcagcctgaggacgaaccactggagagggttcgtcaggatgagcagtcccaagaactggcccagagtgggaggaagcagaatagcaactgccaggtgcttttggagcctgccaggtttggcctccgggagaatgccattgtgaacgtgaagcagtcacagatcttgcatccagtgaagacgtagccagagctctcggcagagaacagattcgatgattgggccaggacaggccacagctctgaactgacgagaggcatctcggtggggcctgctcaggatgaggcttctgagaaaagcccctcaactccacaaagttagggtgg

SEQ ID NO: 2500 - DNA, 3219 bp, Rattus norvegicus
  Genbank Accession No. NM_080888
ccgaccatgtctcacttagtcgagccgccgccgcccctgcacaacaacaacaacaactgcgaggaaggggagcagtccctgccgccgcccgctggcctcaacagttcctgggtggagctacccatgaacagcagcaatggcaacggtaatggaaatgggaagaatgggggcctggagcacgttccttcctcgtcttccatccacaatggagacatggagaagatccttctggatgcgcagcatgagtcgggacagagcagctcaagaggcagttctcactgtgacagcccttcaccacaagaagacgggcaaataatgtttgatgttgagatgcacaccagcagggaccacagctctcagtcagaagaagaagttgtagatggagaaaaagaagttgaggctttgaagaaaagtgcagactgggtatcagactggtccagtagacccgaaaacatcccacccaaagagttccatttcagacaccctaagcgtgcagcctctctaagcatgaggaagagtggagccatgaagaaagggggcattttctctgcagagttcctgaaggtcttcatcccatctctcttcctctctcacgtgttggctttggggctgggcatctatatcggaaaacgactgagcacaccttctgccagcacctactgagggagacgaaaagcccctgggaatccgtgtggcctgtgaagtggtgtattgtagtttgaatttgagacctattgtaagcatgatccccacctacaaccctatttttacatgcccaattccaagtaactctcaaatccagtattttactcaaactctgttggggcattttactaaccttgttccctttttggcctgtaaaacactttagagattcctaacagagtttactgttgtttagaaatttgcaagggcttttttcagcaacgccaccagcagattataatcttgtcaacagtgcatcgtctcctcttagtaccactagtcacacctgcatcattcatgctagaagctgtgttctagccatgcaattacatctctttctaaatgaggtcaggtttgcaaataatactatgaaagctttgtttagtctttgttttgttttccaggacaaaaacaagcttccctgagcttgagtttataaaatgaaaacaaaccaaaaaaaggaaaaaaaaaaaaaaaaaaaaaaaaaaaaaaagaaggcaaaacacaagcaaaaaaaaaatcctgggcaataaaaattactttaaagcagctctggagcccctctttcctcatcctcctgccgccctgaatgggtaggagacagctgtgtgagggacagacaggagagaggagaggagagcatgctcgcaggtttaacatcagtatattgcaatgctgtcttttctatggtagagaatctttatttgtaaggagtgtctcaggcctagacatacatgaaacttacttttgagattttcatgcgtttggtattttcatgtgttaactgcatgtgaatttttcatgactttctttgtttttctagtttctttttttctaagaagagacttggaacgagtctgattcatggtgttaatagaggcttcttgttttaggaagctttgcttacactctggagcctttacactctgaagaataacttcagagttattccaagtacttgtgtaacttggaaaagtagacttgggttgtgggaacagttgataaagttctggaaagatgccattcactctctttgggtccttacttcctgttgttgcctacagtcttcccaaggtctccttagtctctcccaggcccctgtgactgtcttacgtaagtgtcttctcagttctgtcaaattcctgatgctctatagcactcagaaaattctttgaatggcagactttcttctgtctgtttctaaaatgtgaagctttaggaccaaattgctagtatcaggattgcagattatctcaagtagattttgttagatttcagagcacagcatcactctgagggaatctgtgtcttatatataaataattactgttaatgatgtacactttgctgaagttatagaaccattgtgaatttcaaggctagcaacctacacggtgcaccaggttgacttgaataaatttggcaaccaggtttgccagcatgcagaaactcactcttctctcacataaagggttataaaattggtgtgttatatggaaatggaaaggaaggtagataagacatttctgtcatttttcaagaacatggctgtttatctttaaggcagataatatatccaaaatagttttgtgagttattttctttctggcatttaatgtctacctgatttgagggcaacttctgcccttttcctttcttgctcttaaacctggtgatgcttgatctgccttctcacctattacttcaagtgtttataattgagtttcttaggaagaaagcaaatctggtggcctgttgttttgttgttgtttttcaaattgtcaggactgctgaggctaacctgcagcacagtttgcagcactgacgtgtgagcagagcagaatcactctttaatgctcttataggcggacatcacctctctaaattcagtagcagtttcatcggcagtgccattgaactgtgggaacatttatgattttgtctcaaccttaaaactaaatttagttttgccagtttttgaaagtatcaataaaatcatggaatatgtcccagagcaactgtccatcagtgagcatgtacgatgtcgatttgcggttccaacatacaggatgttcatgctcctacacagattcttgttgagtgaaaacagattgccctatcacaaagcaggattcaacagagttgaaatttaagataaggtttaaaaagctttattcctgtttacaatttgggatgaaaagcaggcttcgttctaagtttattgaaacctggctcagatgtttgtaggtcaagagaaaagcggcacagagacagcacagtgagtcactcaattgcagtaaagagtgaaatggagacagcccgtgagacgaatctcacagtgaagcgtttgttggacctcctggtattaatggagccagagtgacatgcatccttcgtctgtctcttcgtcagcactggcgtcattcctttcagtttaaagaacacatgtaacttgtagctataaacattttgtgccattaaagctctcacaaaacttaaaaaaaaaaaaaaaaa

SEQ ID NO: 2501 - DNA, 355 bp, Rattus norvegicus
  Genbank Accession No. NM_080902
gaaaccggcaggactggaagggacgtctcctctccgaagactcttcaagaaatcacaatgtcaaccaacacagaccttcctctctcttcatacgatgaaggtcaggggtccaagtttattcggaaagctagggagacaccgtttgtccccattggaatggccggcttcgcagcgattgttgcatatgggctctacaagctgaagagcaggggaaacacgaagatgtctattcacttgatccacatgcgtgtggcagcccagggctttgttgtgggggccatgactcttggtatgggctattccatgtatcaagaattctgggccaagcgtaagccttagaagagctggtggcatg

SEQ ID NO: 2502 - DNA, 761 bp, Rattus norvegicus
  Genbank Accession No. NM_130400
cccttagtggtactccgctccaggctgcgatttcgcgccaaacttgacggcactctaagctggtggggtctgatcgccgctgcagacatggttcgtccgctgaactgcatcgtcgccgtgtcccaaaatatgggcattggcaagaacggagacttaccctggcctctgctcaggaatgagttcaagtacttccagagaatgaccacaacctcttcagtagaaggtaaacagaatctggtgattatgggtaggaaaacctggttctccattcctgagaagaatcgacctttaaaggacagaattaatatagttctcagtagagaactcaaggaaccaccacaaggagctcattttcttgccaaaagtctggatgatgccttaaaacttattgaacaaccagagctagcaagtaaagtggacatggtctgggtagtcggaggcagctctgtctaccaggaagccatgaatcagccaggccacctcagactctttgtgacaaggatcatgcaggagtttgaaagtgacacattcttcccagaaattgatttggagaaatataaacttctcccagaatacccaggcgtcctctctgagatccaggaggaaaaaggcatcaagtacaagtttgaagtctatgaaaagaaagactaacatgaagatgctcccaagtcctactgcttctcctaaaaggatgcattttataagaccacttctgctggcttgcaatctatgagtaattatttctttagggaggggtggct

SEQ ID NO: 2503 - DNA, 559 bp, Rattus norvegicus
  Genbank Accession No. NM_130403
ggcacgaggacggacgacggcgtgatggcagcgcagcggctgggcaagcgcgtgctgagcaagctgcagtccccttcgcgtgcccgcggcccggggggcagccctagtgggctgcagaagcggcacgcgcgagtcaccgtcaaatacgaccggcgagagctgcagcggcgactggacgtggagaagtggatcgacggacgcttggaagagctgtaccgcggcagggaggcagacatgccagatgaggtcaacatcgacgagctgctggaattggacagtgaggaggaaagatgccggaaaatccggggactcttggaggcttgcctgaatcccacagaggacttcgtccaggagctattggccaagcttcggggcctgcacaagcagccgggcttcccgcagcccagcccctcagatgaccccagcctgagcccccgccaggacccggctcacactgctccaccgtgactgcgcccgcctctgctccacccccaaagcccagattgtttctaagttgtatttaatggttccgtaactggcaaaaaaaaaaaaaaaaaaa

SEQ ID NO: 2504 - DNA, 1386 bp, Rattus norvegicus
  Genbank Accession No. NM_130411
atgagccggcaggtggttcgctccagcaaattccgccacgtgtttggacagccagccaaagctgaccagtgctatgaggatgtgcgcgtctcacaaaccacttgggacagtggcttctgcgctgtcaaccccaagttcatggctctgatctgtgaggccagtgggggaggggccttcctggtgctacccctaggcaagactggacgagtagacaagaatgtgcccctggtgtgcggccacactgcccctgtgctagacatcgcctggtgtccacacaatgacaacgtcattgccagtggctctgaggactgcacagttatggtgtgggagatcccggatgggggcctggtgctgcccttgcgggagcctgttgtcaccttggagggccacaccaagcgggttggcatcgtggcctggcaccccacagcccagaatgtactgctcagcgcaggttgtgacaatgtgatcctggtgtgggatgtgggcactggggcagccgtgctgacgctgggcccggatgtgcacccggacacaatctacagtgtggattggagccgggatggtgctctcatctgtacctcctgccgtgacaagcgtgttcgcgtcatcgagcctcgcaaaggcactgttgtggctgagaaggagcgtcctcatgagggaactcggccagtgcatgctgtgtttgtgtcagaagggaagattctaaccacggggttcagtcgcatgagtgagcggcaggtggcgctgtgggacacaaagcacctggaggagccactgtccctgcaggagctggacacaagcagtggagtcctgctacctttttttgaccctgataccaacatcgtctacctctgtggcaagggtgacagctctatccggtattttgagatcacgtctgaggctccgttcctgcattatctttccatgttcagttccaaggagtctcaacgtggtatgggctacatgcccaaacgtggcctggaagtgaataagtgcgagattgccagattctataagcttcatgagcggaaatgtgagcctattgccatgacagtgcctagaaagtcggacctgttccaggaggacctgtatccacccactgccggacccgaccccgccctcacagctgaggagtggctgagcggtcgtgatgctggccccctcctcatttccctcaaggatggctacgtgcccccaaagagcagggagctgagagtcaacaggggcctggacagtgctcgcagaagagctacaccggagcccagtagcactcttagctcggacaccgtgtcacggctggaggaggatgtgaggaatctcaacgccatagtgcaaaagcttcaagagcgcctggacaggctggaggagactgttcaggccaagtag

SEQ ID NO: 2505 - DNA, 549 bp, Rattus norvegicus
  Genbank Accession No. NM_130431
atgtcgggccgcacagtgccacacgcccacccagccactgccgagtacgaatttgccaaccctagccgcctgggcgagcagcgcttcggagaaggcctcctgccagaagagatcctgacccccaccctctaccatggctactatgttcggccccgggccgccagagctggggagggcggcagggcaggggcctcagagctcaggctcagtgaaggcaagttccaggcatttctggatgtgagccactttaccccagatgaggtgaccgtgaggactgtggacaacctgctagaggtgtctgcccgacacccccaacgtctggaccgccacggcttcgtgtcccgagagttctgtcgcacctatgtcctgcctgcagatgtggacccctggcgggtcagagctgctctctcccatgatggcatccttaacttggaggcaccgcggggtggccggcatctggacacggaagtcaatgaggtctacatctccctgcttcctgcacctcctgaccccgaggaagaggaagaggtagccagagttgaaccctga

SEQ ID NO: 2506 - DNA, 1089 bp, Rattus norvegicus
  Genbank Accession No. NM_130734
ggcacgaggggtcgcggtggcagccgtgcggtgcttggctccctaagctatccggtgccatccttgtcgctgcggcgactcgcaacatctgacgccatgaccgagcaaatgacccttcgtgggaccctcaagggccataatggatgggttacacagatcgccaccactccgcagttcccggacatgatcctgtcggcgtctcgagacaagaccatcatcatgtggaagctgaccagggatgagaccaactacggcataccacaacgtgctcttcgaggtcactcccactttgttagcgatgttgtcatctcctctgatggccagtttgccctctcaggctcctgggatggaaccctacgcctctgggatctcacaacgggcactaccacgagacgatttgtcggccacaccaaggatgtgctgagcgtggctttctcctctgacaaccggcagattgtctctgggtcccgagacaagaccattaagttatggaatactctgggtgtctgcaagtacactgtccaggatgagagtcattcagaatgggtgtcttgtgtccgcttctccccgaacagcagcaaccctatcatcgtctcctgcggatgggacaagctggtcaaggtgtggaatctggctaactgcaagctaaagaccaaccacattggccacactggctatctgaacacagtgactgtctctccagatggatccctctgtgcttctggaggcaaggatggccaggctatgctgtgggatctcaatgaaggcaagcacctttacacattagatggtggagacatcatcaatgccttgtgcttcagccccaaccgctactggctctgtgctgccactggccccagtatcaagatctgggacttggagggcaagatcatggtagatgaactgaagcaagaagttatcagcaccagcagcaaggcagagccaccccagtgtacctctttggcttggtctgctgatggccagactctgtttgctggctataccgacaacttggtgcgtgtatggcaggtgactattggtacccgctaaaagtttatgacagactcttagaaataaactggctttctg

SEQ ID NO: 2507 - DNA, 876 bp, Rattus norvegicus
  Genbank Accession No. NM_130741
ctcttcctcctccggcacacatcggacctagtagctgctgaaaccatgggcctgggtgtcctgtgtctggcccttgtcctgcttggggtcctgcagaggcaggcccaggactcaactcagaacttgatccctgccccacctctgatcagtgtgcccctgcagccaggcttctggaccgaacggttccagggcaggtggttcgttgtcggcctggcagcgaatgcggtccagaaagaaagacaaagccgctttaccatgtacagcaccatctatgagctacaggaagacaatagctacaacgtcacttccatcctcgtcaggggccagggctgtcgctactggatcagaacattcgttccaagctccaggcctggccagttcaccctggggaatattcacagctaccctcagatacagagctacgatgtgcaagtggccgacactgactacgaccagtttgccatggtatttttccagaagacctctgaaaacaaacagtacttcaaagtcaccctgtacggaagaaccaaggggctgtccgatgaactgaaggagcgattcgtcagctttgccaagtctctgggcctcaaggataacaacatcgttttctctgttcccaccgaccaatgcattgacaactgaacagacggtgagcgtggctgactgggatgtgcagtggcctgatggttcaggtcccacctgtctgtctgccgctccatctttcctgttgccagagaatcacctggctgccccaccagccatgattccaccaagcatctgatccctcttatttgatcagctctccccatccacctgtgttaacgctgccccaccaacgggctccccctttctgctgaataaacacatgtccccaaa

SEQ ID NO: 2508 - DNA, 3091 bp, Rattus norvegicus
  Genbank Accession No. NM_130746
gttcgccacgtgtggagagaagggaaaaactgagccgagagaggggggaaaaaaaccaatgctgatttcggaaagaacgaaggaacttcggtagccctggccgaaccaccgacgcaaggaaggtagcgcttccgcagagcggcagcagttctgactggaggggcgctcgctgggagagacccatcacacctaaggggacagctattgctctgggtgacgactcctaaaaagagaatcggtgcctctacctctccacgtagctctgcttcagaacggggattgcttctccagctccccctggaccatgccactgggtggaagaggaacgctgagaggctgagcgaggaaccagctaggtgacaactcagagcccaggagtaccaagtcactgtaaagcataggcaccgtgaggatgactgtggcgagcactgcggctccctcctatacaacctcagacaccaaccgggttatttccaccttttctgttgtggactatgtggtgtttggcctgttgctggttctctcccttgtcattgggctctatcatgcttgccgaggctggggccgccatactgttggtgagctgctgatggcagaccgaaaaatgggctgccttcctgtggcactgtccttgctggccaccttccagtcagccgtggcgatccttgggggaccagctgagatctaccgatttggaacccagtattggttcctggggtgctcctacttcctggggcttctgatccctgctcacatcttcatccctgtcttctaccgcctgcatcttaccagcgcctatgagtacctagagctccgcttcaataaagcagtccggatctgtgggactgtgaccttcatctttcagatggtggtctacatgggagtggctctctatgcaccgtccctggccctcaatgcagtgactggatttgatctatggctgtcagtcctggccctaggaattgtctgcaacatctacactgcactgggtgggctgaaggctgtcatctggacagatgtgttccaaacgttgatcatgttcctagggcagctggtggttatcattgtaggagcggccaaagtgggcggcttggggcatgtatgggctgtggcttcccagcatggcctcatctctgggattgagctggatcctgacccctttgtacgtcatactttctggactttggcctttggcggcgtcttcatgatgctctccttatatggagtgaatcaggctcaggtgcagcgctacctcagttcccactcagagaaggctgctgtgctctcctgctatgcagtgttcccttgccagcaagtggccctctgcatgagctgcctcattggtctggtcatgtttgcctattataagaaatatagtatgagcccccaacaagagcaagcagcccctgaccagttagtcctctattttgtgatggacctcctgaaagacatgccagggctgcccgggctcttcgttgcttgcctcttcagtggatctctcagcaccatatcctccgcattcaattcactggccactgtcacaatggaagacctgatccagccctggttccctcagttgactgaaacccgggccatcatgctctctcgaagccttgcctttgcctatgggctagtttgcctgggaatggcctatgtttcctctcatctgggatcagtgctccaggcagcactcagcatctttggcatggttggagggccactgctgggactcttctgccttgggatgttctttccgtgtgccaaccctcttggtgccattgtaggcctgttgacgggactcaccatggccttctggattggcattgggagcatagtaagcaggatgagttctgctgcagcatcccctccccttaatggatccagctccttcctgcccagcaatctaactgtcgccactgtgaccaccctgatgccttctaccctgtccaagcccacaggactgcagcagttctattccctgtcctatttatggtacagtgcgcacaactccaccacagtcattgcagtgggcctgattgtcagtctgctcactgggggaatgcggggccggtccctgaaccctggcaccatttaccctgtgttgccaaagctccttgcactcctgcccttatcctgccagaagcggctttgctggagaagccacaaccaggatatccctgtggtcaccaacctgtttccagagaagatggggaacggagcgctgcaggacagcagagacaaagagaggatggctgaagatggccttgtccatcagccatgcagccccacctacattgtccaagagacgtccctgtgacctgtgacggacctctcactgcagagcagtggccagagatactctggagtgcagagctgagtcactgcatgagttccgcagcactggggtggatgacctagctcacagcaaaggaccttgatctttaatgtttcaccgccgtgggagctgtcgcatgcaagggacagacagtttttccttatcccttgccagtcttcttttaggatcaggtttgcaaggtacagaatcacagcacacgtggggaaatatactgaggaaagggtggcttttgattaagtgaccagggttctttggggtgaataggaacatttcttacaactccccttgagcaagtttggcaggattgaccagctccagcatttagcatgaagtcctcagccctctggtgattccctcactctcatgtcaacctgggttatctcaagccagtgtgggcctgtggtcttcaggttctctgtaagactcaagtctcctctcattctacctacctctgtttgtgagagggaggctttggagcgcttgggtctcagcacttagtgcatctacttggtgtatagaccctcgctctcttcaggtggtacatgagagacaggtacatgagagaggtcaccaggacctcttatgcagtgtgctatcctctaaactcctaagctaggccaccctggtgtcattctgtcatctgtgcaattcttatttcctttgggagtttcctcctcatgcattttgttcctagggaataaaaatagccattagacctgaaaaaaaaaaaaaaaa

SEQ ID NO: 2509 - DNA, 4645 bp, Rattus norvegicus
  Genbank Accession No. NM_131907
tccctgccaccatcctgctcgttccctccggacgcggctgggctccgtgtggcgccaccgtgccgccagcagcgcccgtcgcccgaggcgcgtggggcgcccccgcagccccgcgatgtggccgtggctgacactaaagactttgtagccatcaaccagagtgcagtttcgatggaaaatgaaggttgcacgatttcaaaagatccctaatgttgaaaatgagacaatgatccctgtactgacatccaagagagcaagtgagttagcagtcagtgaggtcgcaggccttctccaggctgatcttcagaatggcttaaacaaatctgaagttagtcataggcgagccttccatggctggaatgagtttgatatcagtgaagatgaaccattatggaagaagtacatttctcagtttaaaaatcccctcatcatgctgcttctggcttcggcagtcatcagcgttttaatgcgtcagtttgatgatgccgtcagtatcactgtggcaatactgattgttgtcaccgtggcctttgttcaggaatatcgttcagaaaaatctttagaagaattaagtaaacttgtgccaccagaatgccattgtgttcgtgaaggaaaattggagcatacacttgcccgagacttggttccaggtgatacagtttgtctgtctgtgggggacagagttcctgctgacttacgcttattcgaggccgtggatctttccatcgatgagtctagcttgacaggagagacaactccttgttctaaggtgaccgctcctcaaccagctgctaccaatggggatcttgcatcaagaagtaacattgccttcatggggactctggtcagatgtggcaaagcaaagggtattgtcattggaacaggagagaattctgaatttggagaggtctttaagatgatgcaggcagaagaagcaccaaaaacgcctctgcagaagagcatggacctcttgggcaagcagctgtccttttactcctttggtataataggtatcatcatgttggttggctggttactagggaaagacattctggaaatgttcactattagtgtaagtttggctgtagctgcaattcctgaaggtctgcctattgtggtcacagtgacactagcccttggtgttatgagaatggtgaagaaaagggctattgtaaagaaattgcctattgttgaaacgctgggctgctgtaatgtgatttgttcagataaaactggaaccctgacgaagaatgagatgactgttactcacatcctcacttcagacggcctgcatgctgaggttactggagttggctacaatcagtttggtgaagtgattgttgatggtgatgttgttcatggattctataacccagctgttagcagaattgttgaggcgggctgtgtgtgcaacgatgctgtcattaggaacaacactctgatgggaaagccaactgaaggagccttaatcgctctcgcgatgaagatgggtcttgatggactgcaacaagactatatcagaaaagctgaatacccttttagttctgagcagaaatggatggctgttaagtgtgtgcaccgaacacagcaggacagaccagagatttgttttatgaagggtgcttatgagcaggtgattaagtattgtactacgtacaacagcaaagggcagactttggcacttacccagcagcagagagatttgtaccaacaagagaaggcccagatgggctcggcaggactccgagttcttgcactggcgtctggtccggacctggggcagctgaccctccttggcctggtaggaatcattgaccctccgagaactggtgtgaaagaagccgtcacaacactcattgcctcaggagtctccatcaaaatgatcacaggagactctcaggagactgcaattgcaatcgctagtcgtctgggattgtattctaaaacttcacagtctgtgtctggagaagaagtagatacaatggaagtccagcacctttcacagatagtgccaaaggttgcagtattttacagagcaagcccaagacacaagatgaaaattatcaagtctctacaaaagaacgggtcagttgtagccatgacaggagatggggtaaatgatgcagtggctctgaaggctgcagatattggagttgcaatgggccagactggcacagatgtttgcaaagaggctgcggacatgatcttggtggatgatgatttccaaactataatgtctgcaatagaagagggtaaaggcatttataataacattaaaaattttgttagatttcaactgagcacgagtatagcagcattaactttaatctcattggctacgttaatgaactttcctaaccctctcaatgcaatgcagattttgtggatcaatattataatggatggacccccagctcagagccttggagtagagccagtggataaagatgtcattcgaaaaccccctcggaactggaaggacagcattttgacaaaaaacttgatccttaaaatacttgtttcatcaataatcattgtctgtgggactttgtttgtcttctggcgagagcttcgagacaatgtgataacaccccgagacacaacaatgactttcacttgcttcgtgttttttgatatgttcaatgcactgagttccagatctcagactaagtctgtgtttgagattggactctgcagtaataagatgttctgctatgcggttcttggatccatcatggggcagttgcttgttatctacttcccgcctctgcagaaggtttttcagaccgagagcctcagtattctggatctgttgtttcttttgggtctcacttcatcagtgtgcattgtgtctgaaattataaagaaggttgaaaggagcagggaaaagactcagaagaacactacttcaacaccatcgtcttttcttgaagtatgatgcatattgcattttttttttcatttgcaaactaggaattgcagtctgggaatcatttagaagggcaagttcaagaggataatgaagatttaaggacttttaaactttccattgactaaaaatgaccattaatgttaaagacttgatttgaaccttgttggtagtcccaaatgaaattatgcaactttgaataacacgttccttgatttgaattggcttttgcaatcgattggaacttcaacatatggtcaagtactgaattaaaaaagtacaaaaggcaaaacgtgaacaccttctgcacttagagttctaatgtacaaatacactatctgtcttagatggatataaatattttttttatttttaaatattgtactatttatggttgtggggctttcttactaatacactcaataaatgcactcagtcatttcaaaggcattctatttggtttagaaattgccaggagtgccatatttcagctaccatgtttcctttttcctgcaatgtacgcaaatgataccttgtgctaccatttttatatttcaagttttttattttttatttttgcacaggatgtgaccactgtctaatcactgttctttctttttgtgactgaaaagcatatactgcaattgaagtaaatgtttgctcttcttagtaagtgtacatggttgttttggttttttgtagtggttttccacagaggtgtgagtctttgacctagcaggattagttcaggctgttgttgcattacagttagagtaattgtacttaacacagtcaaagagtcaaaaacaacaaaggccggatggaatttcaaacagactatgttaacacgtccttgtttaggttaatacagttctactttgtcagtgtcatcttgtcatttcttctttataaatcaaacacttcagctaaataattgacctttattactgtttcatatttgtatttttaagtctatttcttagagagtatagactaccatacttagaaaatcaaaagtcccaaactcagagagataggacatgaaccagggtgtccatcagaagatcctgtgcaggccttgctcctccgaatcctctaggcagccgctttggcctagattgtagcacaaccctgagtctgtcccttctgccgtttgttgggatccgtcttcttcttttggtatgcttgggaaatagatggatttgctttgtgtaaaccatcagtttttataagagcttgacaaaataaaggtaagtgttgaatcttgtatttcataaactgtcagaattaactgttctgagcttgttcaatattactggtgagtgttaacgctgctgcgctgtcgttgataggagaactctgttgtctgagtctgtactactgaagcatgaacgtaaggagccagatgtctgactttgtcttaatctctcaggctcaactgtcagtgtacattgttctgtctcattaggtgggacgtgaggtcactgtcaaccaactcatagaggtttgatgtctcatagcaaaattttataatggttttttacattctgttccaaacttgaaaactacatattaagtgcatattcagtcttgtttgttttacagtagaggttgagaatatgactcatgaaatgaatgtgcctatcttttcacttggtattgaactataaaaataaagtgagtttttcataagttcaaaaaaaaaaaaaaaaaaaa

SEQ ID NO: 2510 - DNA, 1376 bp, Rattus norvegicus
  Genbank Accession No. NM_133283
gggggtgccgcgccggccgcagagccctgatgctggcccggaggaagccggtgttaccggcactcaccatcaaccctaccatcgctgagggcccgtcccccaccagcgagggcgcctccgaggcacacctggtggacctccagaagaagttggaagagctggacctggatgaacagcagaggaagcggctggaggccttccttacccagaaggccaaggttggtgagctcaaggacgacgactttgagagaatctcagaactgggtgcaggcaatggcggcgtggtcacaaaggcccggcataggccctctggcctcatcatggccagaaagctgatccacctggagatcaagccagctgtccgcaaccagatcatccgggagctgcaggtgctgcatgagtgcaactcaccgtacatcgtgggcttttatggggccttctacagcgacggcgagatcagcatctgcatggagcacatggacggtggctcactggaccaggtactgaaggaggccaagcgcattcccgaggacatcttagggaaggtcagcattgcggtgctccggggcctggcgtacctccgcgagaagcaccagatcatgcatagagatgtgaagccctccaacattctggtgaactctcgtggagagattaagctgtgcgacttcggagtgagcggccagttgattgactccatggccaactcatttgtagggacacgctcctacatgtccccagaacggctgcagggcacccactactctgtgcagtcggacatctggagcatggggctgtcgctggtggagctggccatcgggaggtaccccatccccccacctgatgccaaggaactagaggccagctttggccggcctgtggtggacggggcagatggagagccccatagtgtctcaccgcggccccggccccctggacgccccatcagtggtcatgggatggacagccgaccagccatggccatctttgagctgctggactacatagtgaatgagccacctcccaagctgcccagtggtgtgttcagctcagacttccaggagtttgtgaataaatgtctcattaagaacccagcagagcgtgcagacctcaagctgctgacgaaccatgccttcatcaaacgctctgagggggaggacgtggacttcgctggctggctatgcagaaccctgcggctgaagcagcccagcacacccacgcgtactgcagtgtgacagccatcgctcagcagtctgtgtccttgtcctgtggcacagcggccgcctttggggacagcagtggtgtgtgttgtggcaggggacctgtgcctgtgcatttggaaaagcaaacaaagtggagaaagagagaaaaaaaaaaaa

SEQ ID NO: 2511 - DNA, 963 bp, Rattus norvegicus
  Genbank Accession No. NM_133290
atggatctctctgccatctacgagagccttatgtcgatgagccatgacctgtcacccgaccacggaggaactgagtcctccggaggactttggaacataaactcatcggactccatcccatctggggtcacctctcgcctgactggccgctccactagcctggtggagggccgaagctgcagctgggtacccccaccccctggtttcgcacccttggctccccgcccgggccctgagctgtcaccctcacctacttcgcctactgcaactcccaccacctcctctcgatacaagactgagctctgtcggacctactcagagagcgggcgttgtcgctatggggccaagtgccagtttgcccacggcccgggtgaactgcgccaagccaatcgccaccccaagtacaaaacggaactctgccacaagttctacctccagggccgctgcccctacggctctcgatgccacttcatccacaaccctaccgaggacctggctctccctggccagccccatgtgctccgacaaagcatcagcttctcaggcttgccttcaggccgcagaacctcaccaccacctccaggcttctctggcccttccctgtcctcttgctccttttcgccttccagctccccaccaccgcctggggaccttccactttccccttctgccttctctgctgcccctgggacccctgtgtctcgaagagaccctaccccagcctgttgtccctcctgccgaaggtctactacccctagcaccatctgggggcccttgggtggtctggctcggagcccatctgcacactctctgggatccgaccctgatgattacgccagcagcggcagcagcctgggtgggtcagactcgcctgtctttgaggccggggtgtttgggcctcctcagccccctgcacccccaaggcgtcttcccatcttcaatcgcatctctgtctctgagtga

SEQ ID NO: 2512 - DNA, 1935 bp, Rattus norvegicus
  Genbank Accession No. NM_133295
caaaggaacaaatagcccacagatccgcagaacccttgtccttccacaatgcgcctctaccctctggtctggctttttcttgctgcgtgcacagcttgggggtacccatcctcaccacctgtggtgaacactgttaaaggcaaagtcctggggaagtatgtcaatttggaaggatttgcacagcctgtggctgttttcctgggaatccccttcgccaagccccctcttggctccttgaggtttgctccaccacagcctgcagagccttggaactttgtgaagaatactacctcctacccacctatgtgctctcaagatgctgttggagggcaggttctctcagagcttttcaccaacaggaaggaaaacattcctttacagttttctgaagactgcctctacctgaacgtttatactccggctgacttgacaaagaacagccggctaccagtgatggtgtggatccatggaggtggactggtagtgggtggagcatccacctatgatggacaggtcctctctgcccatgaaaatgtggtggtggtgaccattcagtatcgccttggcatctggggattcttcagcacaggggatgaacacagccggggcaactggggtcacttggaccaggtggctgcactacactgggtccaggacaacattgccaactttgggggtaacccaggctctgtgaccatctttggagaatctgcaggaggtttcagtgtctctgctcttgtgttatctcctctggccaagaacctcttccacagggccatttctgagagtggtgtggtcctcacttctgctctgattacaacagatagcaagcccattgctaagctgattgctacactttctgggtgtaaaaccaccacatcagctgttatggttcattgcctgcgccagaagacagaggatgaactcctggagacttcattaaaattgaatcttttcaaactggacttacttggaaacccaaaagagagctatcccttcctacctactgtgattgacggagtggtgctgccaaagacaccagaagagatcctggctgagaagagtttcaacacagtcccctacatagtgggcatcaacaagcaagagtttggctggatcattccaacgcttatgggctatccactctccgaaggcaaactggaccagaaaacagccaaatccctcttgtggaagtcctacccaacactgaaaatctctgagaaaatgattccagtggttgctgagaagtacttcggagggacagatgaccctgccaaaaggaaagacctgttccaggacttggttgcagatgtgatatttggtgtcccatcagtaatggtgtctcgaagtcacagagatgctggagcccccaccttcatgtatgaatttgagtatcgcccaagctttgtatcagccatgaggcccaagacagtgatcggagaccatggtgatgaactcttctcagtatttggatctccatttttaaaagatggtgcctcagaagaggagaccaatctcagcaaaatggtgatgaaatactgggccaactttgctcggaatgggagccctaatgggggagggctgccccattggccagaatatgaccagaaggaagggtacctgaagattggtgcctcaactcaggcagcccagaggctgaaggacaaagaagtggctttttggtctgagctcagggccaaggaggcagcagaggaaccatcccactggaaacatgttgagctctgatcaggagggtcagccatgtttgagaacctgaagctaaaggggaattattccacagaagattttgtaaagacataacacttcttgtctttgagactataacatcacatggtattttgtacaaatgcattaaagggaaaatacttaaccttattgcttcaacttgtaaaataaaacattgtttagaaattc

SEQ ID NO: 2513 - DNA, 2320 bp, Rattus norvegicus
  Genbank Accession No. NM_133298
gtatttcataaaacagagaggatcgcaggaggccggcactctgactcctggtggatgggactagggagtcagagtcaagccctgactggctgagggcgggcgctccgagtcagcatggaaagtctctgcggggtcctggtatttctgctgctggctgcaggactgccgctccaggcggccaagcggttccgtgatgtgctgggccatgagcagtatccggatcacatgagggagaacaaccaattacgtggctggtcttcagatgaaaatgaatgggatgaacagctgtatccagtgtggaggaggggagagggcagatggaaggactcctgggaaggaggccgtgtgcaggcagccctaaccagtgattcaccggccttggtgggttccaatatcaccttcgtagtgaacctggtgttccccagatgccagaaggaagatgccaacggcaatatcgtctatgagaggaactgcagaagtgatttggagctggcttctgacccgtatgtctacaactggaccacaggggcagacgatgaggactgggaagacaacaccagccaaggccagcacctcaggttccccgacgggaagcccttccctcgcccccacggacggaagaaatggaacttcgtctacgtcttccacacacttggtcagtattttcaaaagctgggtcagtgttcagcacgagtttctataaacacagtcaacttgacagttggccctcaggtcatggaagtgattgtctttcgaagacacggccgggcatacattcccatctccaaagtgaaagacgtgtatgtgataacagatcagatccctatattcgtgaccatgtaccagaagaatgaccggaactcgtctgatgaaaccttcctcagagacctccccattttcttcgatgtcctcattcacgatcccagtcatttcctcaactactctgccatttcctacaagtggaactttggggacaacactggcctgtttgtctccaacaatcacactttgaatcacacgtatgtgctcaatggaaccttcaactttaacctcaccgtgcaaactgcagtgccgggaccatgcccctcacccacaccttcgccttcttcttcgacttctccttcgcctgcatcttcgccttcacccacattatcaacacctagtccctctttaatgcctactggctacaaatccatggagctgagtgacatttccaatgaaaactgccgaataaacagatatggttacttcagagccaccatcacaattgtagatggaatcctagaagtcaacatcatccaggtagcagatgtcccaatccccacactgcagcctgacaactcactgatggacttcattgtgacctgcaaaggggccactcccacggaagcctgtacgatcatctctgaccccacctgccagatcgcccagaacagggtgtgcagcccggtggctgtggatgagctgtgcctcctgtccgtgaggagagccttcaatgggtccggcacgtactgtgtgaatttcactctgggagacgatgcaagcctggccctcaccagcgccctgatctctatccctggcaaagacctaggctcccctctgagaacagtgaatggtgtcctgatctccattggctgcctggccatgtttgtcaccatggttaccatcttgctgtacaaaaaacacaagacgtacaagccaataggaaactgcaccaggaacgtggtcaagggcaaaggcctgagtgtttttctcagccatgcaaaagccccgttctcccgaggagaccgggagaaggatccactgctccaggacaagccatggatgctctaagtcttcactctcacttctgactgggaacccactcttctgtgcatgtatgtgagctgtgcagaagtacatgactggtagctgttgttttctacggattattgtaaaatgtatatcatggtttagggagtgtagttaattggcattttagtgaagggatgggaagacagtatttcttcgcatctgtattgtggtttttatactgttaatagggtgggcacattgtgtctgaagggggagggggaggtcactgctacttaaggtcctaggttaactgggagaggatgccccaggctccttagatttctacacaagatgtgcctgaacccagctagtcctgacctaaaggccatgcttcatcaactctatctcagctcattgaacatacctgagcgcctgatggaattataatggaaccaagcttgttgtatggtgtgtgtgtgtacataagatactcattaaaaagacagtctattaaaaaaaaaaaaaa

SEQ ID NO: 2514 - DNA, 3101 bp, Rattus norvegicus
  Genbank Accession No. NM_133303
tgtctacaccataattcctttgtctttgagccagctcacaaatgtcactgtggttctgagtgtgggggtcttggtgcagtccctcccctcccagtcccttccgtcgaggagcatggtgctagtgctgccacagcctggagacgcacacaaccccccaaaatctctccagacgaccgtcccacgatcacaggacagaaccctccaaatcgaaacggaggaaacggacagccattgaacatggacgaaggaatccctcatttgcaagagagacagttactggaacatagggattttataggactggactattcctctttgtatatgtgtaaacccaaaaggagcttgaagcgagacgacaccaaggatacctacaaattaccgcacagattaatagaaaagaagagacgagaccgaattaatgaatgtattgctcagctgaaagacttactgcctgaacatctgaaattgacaacactggggcatctggagaaagcagtagtcttggaattaactttgaagcacttaaaagctttaacagccttaacggagcagcagcatcagaagataattgctttacagaatggggagcgctctctgaaatcgccggtccaggccgacttggatgcgttccactcggggtttcaaacctgcgccaaagaagtcttgcaatacctcgcgcgctttgagagctggacgcccagggaaccgcgctgcgcacagctcgtcagccacctgcacgccgtggctacccagcttctgacgccacaggtgaccccaggcaggggccctgggcgcgcgccctgcagcgctggggctgcagccgcctccggttccgagcgcgtcgcccgctgcgtgccggtcatccagcggactcagcccggcacggagcccgagcacgacacggacaccgacagcggctatggaggcgaggcggagcagggccgcgccgccgtcaagcaggagccacccggggacccgtcgctgcgcccaagaggctgaagctggaggcgcgcggcgcgctcctgggcccggagcccgcgctgctcggctctctcgtggcgttgggcgggggtgcgcccttcgcgcagcccgccgccgcgcccttctgcctgcccttctacctgctgtcgccgtccgccgccgcctacgtacagccctggctagacaagagtggcctggacaagtatctgtaccccgcggcggccgcgcccttcccgctgctgtatcccggcatccccgcagcagccgccgctgccgccgccgccgctttcccttgcttgtcgtccgtgctatcgccacccccggagaaggcaggttcggccgctggtgccccattcctggcgcacgaggtggcgcccccggggtcgctgcgcccccagcacgcgcatagccgcacccacctgccgcacgccgtgaacccagagagctctcaggaagatgccacgcagccggccaaggacgccccctgaacccagcattccttccagaacagggcagggggctcctgaggagtcgccaggtttccaagttcaaacatcccctaaggcgtaccagggaggaagagtaagagatgctctgctcgacaggcttaggacaaaaacaggtgttttgtgtatgtttggagttcctgttttgcccctttctcacccttctgccaccccaccctctaccctttgacactcccttccccatccctgctgtcacagagcctccctgagaaatactggttatcttaaattaccctcccttacatttagttcacgtcctctgtttccaaacatagaccctggttcaggagtctgttgggtgggagagccacacggaaccagttagagtgcctggtatcagggctccttgacccaggcctggaacagtagctgtgtcccctgtctgtccccttaggaggtgacccataactgagggtctctgaaagttacattgacgtgtcagtattttgtattcttcagctttttggaaggtacctctttttcaaagaagtgaggatgccattgccctgttgtgaggtggctggagtggtgtctttataccttgcacctgttgggagaaactgagagttggggccatcttcaggcactgtgtcagtgtgggagctggaagagggagtttggagcccgtggcgcctttctcgcactttattgacaaattgacctcaacccctttgtcccatgtctcaactcacagatatatgtcataggttatatatttgtgtttctgatccctcgttattttatccatcatggtcccaaatttttgtaatgttactggggtttggggtggggtggggtgttaaagtgctctgggctggaaaaagacaagcccaaacctattgattgtcgaattcttagatgacagaagtggagagaggggcttgtggtcccttgtgatgggaagtgctgtgaacatgtagaaggccctgccagcctcgctctctcaagtctgtatgtatttttcgggagaccaaaccagacaccagataatcaggaagaaagctttttaaaataaggcaaaaaccgagaccttgtctagatatttttagtttgttgccaaggtagcactgagaaatctcacttgaatgttacataaggagtgattcacaatagtctagagtgaagaaagttatctgggtctgtgagtgttcgggtccgtttgctgctgctgttgctactgtttgcctcaaacgctgtgtttaaacaacgttaaacttcttagcctaccaaggcggccgtatgtacatagctgttaatacccccaactaatgtctgacatgctatttttgtagggagaagatacctgctagtgatattttgagttaaaatatcttttggggcggacttggtgaaatgtttgcactttggtcacaatgcttctactgcttggtgcaacgttacgctgtcttaaattattaaacaaataaaaaatactatctgcaagaaaaaccagctggtttagacaagtttagtatgtaaagataagctagaaactatctttatattctagtattttcagcactccatattacctaaatattgccacactattttgtgatttaaaagttcttactaaggaataaaatctttata

SEQ ID NO: 2515 - DNA, 3750 bp, Rattus norvegicus
  Genbank Accession No. NM_133306
atttaaactgcatcagaagctcgagcactggcagttggctgactgaggtcctctactgtttcagtttcccattcttggcatgaatttggaaatggcttttgatgacaagatgaagcctgtgaatggccagcctgatcagaagtcatgtggcaagaagcctaaagggctgcatttgctttcttccacatggtggtgccctgctgctgtgactctggccatcctttgcctagtgttatcagtgacccttattgtacagcagacacagttactccaggtatctgacctcctaaagcaataccaagcaaaccttactcagcaggatcatatcctggaggggcagatgtcagcccagaagaaagcagaaaatgcttcacaagaatcaaagagggaactgaaggaacagatagacaccctcacctggaagctaaacgagaaatccaaagagcaggagaagcttctgcagcagaatcagaacctccaagaagccctgcagagagctgtgaacgcttcagaggagtccaagtgggaactgaaggaacaaatagacattctcaactggaagctgaatgggatatccaaagagcagaaggagcttctgcagcagaatcagaacctccaagaagccctgcagaaagctgagaaatattcagaggagtcccagagagaactgaaggaacagatagacaccctcagctggaagctaaacgagaaatccaaagagcaggaggagcttctgcagcagaatcagaatcttcaagaagccctgcagagagctgcaaactcttcaggtccttgtccacaagactggatctggcataaagaaaactgttacctcttccatgggccctttaactgggaaaaaagtcgggagaattgcctatctttagatgcccagttactacaaattagtaccacagatgatctgaacttcgtcttacaagcaacttcccattccacctccccattttggatgggattacatcggaaaaatcccaaccacccatggctatgggagaacggctctcctttgagttttcaattctttaggaccaggggcgtttctttacagatgtactcatcaggcacctgtgcatatattcaaggaggagttgtgtttgctgaaaactgcattttaactgcattcagcatatgtcagaagaaggcaaatttattgctaactcagtgaaactaaggattctggagaagaacaggagaagacctttaactgttgttttgaaatttaagctatcctttcttgggtgtaaaacatgtggccttgacagctgtcagttactttctaactgcagttcacctcaacagagacaaagaccagaagcaaaaacccgggggtccagctgatggcatctttgtatcaaaagttgtgaattcaattgtttatccatgtacactggccccgcccctcccaagactcccaaccaacctgcaatcctttttttctttcttgttttaaactatgcctcctgtctgacctgggggatgctttctgctcaatttcctctacctcaggtatgccttctgttgctgcatgaaagacagaatgtagaaaaccttcttcaagtgcaggcagagagctcaaagttaaaaacatgcctaagaaatagcatgcaaagaaacagaactggaaaagctacactgtacgcaggagctcatggtctctaaaaagctatggcttgatcttcacgacttgggtccatctccagactgcaccatttacacatttatgtttttttattttatttttattgtgtgtttatggatagttggcctatatgtatctctgtgtaccacatgagtgtctccattcagaagagggcatcagattctctgaaactggaactgcagatggctgtaagctactacatagatgtaaagaattgaattcatgtcctctgaaagaacagtcagtactcttaaccatgaactatttctccaggtcccgtgatcatttcttgtatcagctatttcttcacatttgctctaccaaagaacagagcttaaaacagtattttataaagccatagaatatggccccaaaacaaaactagaatttttcccttaaattgcatactttgtagacagtctctccttgaccctgccatgccatgctatgacttagaaacatacatgaccaaaatggatgaaactcagttgaagaacaagttcttagaatcacctgagctgggtataaaaatattgttctatgggaacagatggatttagaaatatctattatcagggcctccaccatccccacaagtcacagactcttccatttcaaaggaagctttccattatgctagaggtaatatagcatatatgtcatgtatatgagtgtgtatttgtgtgtgtgagtgtgtgtgttcatatgctagatacgtccttgagaagatgagacattggcagctttgtgtgtaatgaatttgcaataatccaaatttgtaagtagtttccatggttccttatagtgatgacatcaccacagccaagatgatgagcatacctgttgtttctgcccctttccaatgcttcctccctagaacaaacaccaatctgttgtcagttgtcatttcatagagtttataatcttgtttttaagagagaatctcattatatagttctgactgccctgggactcactacacagaccagcctggcctccaccttccagagttcctcctgcctttgactcacaagtgctaacactgaaggagtgcaccgccatgtatggctcatgcagtttatgtgaatggaatagtataacacatccagattttctcagttcagtttcttccacttggtgctattattttggtattcatacatctctgcctcagtgtttgtatcagttcttcaatttttttaaaatgttgatcattcccctggtgggtacatattgtcatttttatctgtgtatttgttgatgtcatttgggttgtttttgtttggggtcacctacaaataaagctgctatgaatgcccatggacgattctggtttctcatgtaagcacctctgagtgtgacacttgggtcattcagtgtgtgaatatatggttggccatgttaaccattgctttttgaaatttccaattttttttaaaattagtcgactttacatctcaactccaatttccttccctcctctcctctcaatcttcacccacctccctctcctacccccatccactcttccctttctcttcagaaaagaggaggcttcccacagatgtcaaccagccttagcgtatcaagttgcagtaagaataggtttatcatcttctatgaaagccttaatttttagacttatcactgtatatgcagtattttgtttgcatgtatgtattggtaccacatatatgcctaataccagaggaagtcagaagagggcatggtatcttctgagactggaattacagacatttttgagccatcctacagactctggaaattgaacccaggatttctggaaagttaggcagtgctcttaacccctgaaccatctcttcaggccctatagcaatctttattgatatgtaactgtgtataattgcacttttagtttgaagttcttaaatggcaaatagtcttgaatttattttcatgttatcatttactgtctgtacattttctgtaatgaaataactaagcatatcttttgagaattttattttcttacattttaaatctgaaggatttacatacatactggagaataaaaacagcctaatgtg

SEQ ID NO: 2516 - DNA, 3576 bp, Rattus norvegicus
  Genbank Accession No. NM_133380
gcgtccgggcggcgtaggaaaccgggcgaggtccttcgcgcaggaaagccccgcacggcgcgtggagcctgaacacacaggtgctggagagggagcccaggatctgggggccaggtacgctgccactgagctgcattccagtctctccctgtatagcccaggcacctttgtgtccgcaatggggtggctttgcaccaagttcctgtcctccgtgagctgtctgattttgctatgggtgactggctctgggggcatcaaggtcctgggtgaccccacctgcttctctgactacatccgcacttctacgtgtgagtggcagctggatagcactgtggactgcagttctcagctcctcctggactacaggctgctctttgagttctctgaaaacctcacatgcacccccaagaacagtgccgacaccgtgtgtgtgtgccaaatggccatagaggagccgatccaggcagacacatactggctggaactgtggtctgagcggggacagctgtggcaaggctccttcaagcctagtgacaatgtgaagcccccagctccagacaacctcacactccacaccaatgtctccaatgcgctgctgctgatgtggagcaacccatacccatcgaacaacttcctgcacaaaggcctcatctgcatggtcaacatctccagagaggacaacccggcggaattcaaagtctataatgtgacctacacggaacccaagctgagcttcccagtcaacaccctaacatcaggggtgcgctatagggcacgtgtgagggtcttgtcccagagcttccctggcatctggagtgagtggagtcccagcatcacgtggtacaacccaaataatgtcaatctgtgactgaatgaccttgggggctccagtggtgaggagagcacacagagcagtggagctgacttccagctgcccctgctgcagcgcctcccgctgggtgtcagcatctcctgcatctgcatcctattgttttgcctgacctgttacttcagcattatcaagattaagaagatatggtgggaccagattcccactccagcacgcagtcccttagcagccatcatcattcaggacacgaaggtgtccctctgggagaagcagacccgaagccaggagtcaaccaagagccggcactggaagacttgtctaaccaagctgctgccctgcttgctggagcatagagtgaagaaagagagagaatccccgaaggctgccaaaaccaagcctctccagagtcctgaaaaagcaggctggtatcctgcggaggtcagcaggaccgtcctctggccagagaacgttcatgtcagtgtggtgcgctgtatggagctgtttgaggccccagtacagaatgtggaggaggaagaggatgagatggtcaaaggggacctgagcatgtcacctgagaacagcggagggggcttccaggagagtcaggcagacatcatggcccggctcactgagaacctgttttcagacttgctgggggctgagaatggaggcgttggccagtcgagcatggcagagtcatcctcccttctgccttcagaaagtgggcaagcttctacgtcctgggcctgcttccccacggggcccagtgagaccacatgccaggtcacagggcagcagcctccacacccagaccctgagagagcaactggcacagcctgcacacaggtcccccttgtcatttcagacaatcctgcctaccggagttttagtgacttctccagccccgccccaaatcctggagagctggcttcagaacagaagcaggctggacatctggaagaaggggatcttctgagcccggttgacccccattcttcagggccaccaatgcagcaagcggagagctgggagcagatccttcacatgagtgtcctgcagcacgggacagctggctccaccccagcccctaccagtggctaccaagagtttgtgcaggcagtgaagcagggtgcgtcccaggacgctggggtgcctggtgtcgggccttctggagacactggttacaaggctttctcgagcctgctcagcagcagtggcgtctgcacggacacagcagcagcagggactgacagtggatgtggagggtacaagcccttccagaaccctgttcctaaccagtcccccaactccatgcccttattcaccttcggactggacatggagctgccacccagtcccctgaactcagccccacccaatagcaccccagaatgccttggtctagagctggggctcaaaggaggcacctggctgaaggcccctcctccttcagagcaggtgcccaagccctttggggatgacctgggccttggcattgtgtactcgtccctcacctgccatctgtgtggccacctgaagcaacaccacagccaggaggaagatggtcagatccatgtcgttgctagccctggctgcggctgttgctatgatgaaaaatcaccatccttggggaatctctcggggaccttggagagctgtcctggggaaatgtcacaggaagccaacctcaccttagcacccaggacaccctccaatttgtcaggggtgggcaagggccctggccactctcctgttcccagccagactactgaggtacctgtgggcactctgggcgtcactgtgtcttaggtgagtgtgctgttgttgctgaggtctgtgctaaggccggggttcctccaagccagggaagtgcttcctgagagacagcccagctggcaggtttcccagaaatcgaaagaatggtgaagtgaagatgtgaacttggcctgaccctagaagttcagagcctggctgtctcccctaccgttggcctgggctctcctccctcacaagggattcagggactcattttgctttctcccacagcagtgctgatattcttaagccctgggctctcctagctcttgttgccctacctgctcaggcccattctgtccacccaatagaccgtttgcccaaggctcacagcagtcctggcatagctgtcgggttctccagctggaagctggtcctagaaactcgcagctggcctggcagtggcttgggaggccctaactagtggaaattttgagttaagggagggtagatactgccccaaggaggctattcattgaacagctcggactgagactagaagcagagcctgctgtcccagcttggcccagttgtggaaagcaacaagaacgcaaacttgattgcccaaagtcactgccagttacccacatgtggccagaagccagggctcccaggatgtggaagtgggatcccagtaaacaaacacagcagcctagtggcaggtcccagtggacaccaccactggcagccaaggcgagaccacaagggaactgtggggctggttctggttggtggccagatgatagggatggcagatggcagactgcagtctgactgcattctggaggacgggaccaggctcaggactgtctgctcgtgtccctacctttgggacacctagtatgtttgcaaggagggcaggacagaagaggtcacgtggagctctatgtcaataaagactctttatcttg

SEQ ID NO: 2517 - DNA, 2648 bp, Rattus norvegicus
  Genbank Accession No. NM_133386
gcgcctcactttcgcgctccgtggatgcgctgcttcaggccgagctcggaaccccgcgccttgcccacttcctgagttgctcctccagcgtcggggtgcacaattctgtccagggatccagcccctcatctgcgcgtggccgagccctgggtggcggcgactgtgtttggggcggtacagcgagatcccgggcgggtgggggaccagggctgcgctcaaccttggttccacccggagagaacaaggaacgcggggcgtggtcaggcccgcccagaggctcagcgccttccccgggccgtggcgaagttgagcaaaaagtttgaggctggaggggagcgatcccttggagtctgtgtgagaccagtgcttcagttgtccctccgtcgcggagctgagcccgagaagagttgctttccgtccctggccgctagagggacagactgggtagggacctccaccggtagttggcggcgccttcgtgggtctgtgagggagacggccccacgcctgtgccttggcgcgaactcgcgtctagcagggcagactgcagctgtgggttcatcagcacgggcaggtttggcgggactttgggcgctgttctcaccagcgcgtcttgcaccagccctcccccaccccgccctcctggagactcggagacctagcggcttccgagctcaggcaggggaccggcgacccggcaggttgagacgcggttcttcgtcccagagtatgcgcctcgcaatgccggttctgggaattttatgcaactggactctccaccaacctcaaagggtgaagagccggcctgacgaagagagccaggagtcactgactcatgcgtcgggcccgaatccggagtcccttggaacggaacgttcgtggggtgggaagtttagtagaaagctagattccccgacccacggggttctggtgattcagtcgtgtgcagcaccctacgctaggtccagggcctctggttgggcaccctgtccacgtgcttggagcccaggcagcgaaccccaccactctttcctcctgtccctcagatctggccgcctccgggaatgacgagggcgctctcacagcccagggaggtggagagggcgagccccacggccagtcaccagacacccgcctgggcaacaccgataagcagctgcacactggagccgccgttacctctagcagcgccggggcagcatcggtggctccttgtcagcgggagccccgggacctggctatgcaaccagcagactgtccccggggactgctcccacggccatgcagagtgttggtgctgctgaacccccggggtggcaagggcaaggctctgaagctctttcagagccgtgtgcggccccttctggaggaggctgaggtatcctttaaactgatgctcaccgaacggcagaaccatgccagggagctggtgtgtgcagaagaactgggtcactgggatgccttggcggtcatgtccggtgacggtctgatgcacgaggtggtgaatgggctaatggaacgacctgactgggagagtgccatccagaaacccctatgtagcctccctggaggctctggcaatgcgctggcagcttctttgaactactatgctgggcacgagcaggtcactaatgaagatctcctgatcaactgcacactgctgttatgctgccggcagctgtcacccatgaatctgctgtccctgcacaccgcttccggacggcaactctattctgttctcagtctgtcctggggtttcgttgctgacgtggacttggagagtgagaaatacaggagcttgggggagattcgtttcacggtgggaaccttttttcgcctagcaagcctgcgcatttaccaaggccaactggcctaccttcctgtagggaaggctgcctctaagatacctgcttcctcactggcacagaagggccctgccaacacatacctcgttcctctggaggagccagtgccacctcattggactgtggtgccagagcaggacttcgttctggtgctggtgctgcttcacacccacctgagcacagagatgtttgcagcacccatgggccgctgcgaggctggtgttatgcatctgttctatatacgtgcgggggtgtcaagggccatgctcgtgcgcctcttcctggccatgcagaagggcaagcatatggacctcgactgcccgtacttggttcatgtgccagtggttgccttccgcctggaacccaggaaccagaggggagtgttttctgtggacggggagctgatggtgtgtgaagctgtgcagggccaagtgcacccaaactacctttggatggtctctggtagcagtgactccccgtccggccgggactcccagcggaggccacctccagaagaaccaatatgactctgtgcctttgtctactatgtctacactgagtatgggaccctcctctcatcctatctcctggtatgggaggttatttcaaagctcatatggaggaggtggggacccctgtagagaaagctggaaggtggggtctatgttttggaaagactctaccctctagttagaatgagactggggtcagagtcccactggctgggccagttcgcatacagttgctcttggagccctgtcctgagaaccaaattcaaataaa

SEQ ID NO: 2518 - DNA, 1359 bp, Rattus norvegicus
  Genbank Accession No. NM_133409
atggacgacattttcactcagtgccgggagggcaacgcggtggcggtgcgcttgtggctggacaacacagagaacgacctaaatcagggggatgatcatggcttctcccctttgcactgggcctgccgagaaggccgatctgcagtggttgaaatgctgatcatgcggggagcacggatcaatgtgatgaatcgtggggatgatacccccctgcacttggcagctagtcacggacaccgtgacattgtacagaagctgttgcaatacaaggctgacatcaatgcagtgaatgaacatgggaatgtgccccttcactatgcatgtttctggggccaagaccaggtggcagaggacctagtagctaacggggctcttgtgagcatctgtaacaagtatggagagatgcctgtggacaaagccaaggcaccccttcgagagcttctccgagaacgggcagagaagatgggccagaatcttaatcgtattccatacaaggacacattctggaaggggaccactcgcacaaggccccgaaatgggaccctgaacaaacactctggtattgacttcaaacagcttaacttcctggcaaagctcaacgagaatcattctggagagctatggaaaggccgctggcagggcaatgacattgttgtgaaggtgctgaaggttcgagactggagtacaaggaaaagcagggacttcaatgaggaatgtccccggctcaggattttctctcatcctaacgtgcttccggtactaggtgcttgccaggctcccccagctccccacccaaccctcatcacacactggatgccatatggatctctctacaatgttctacatgaaggcaccaatttcgttgtggaccagagccaagctgtaaagtttgctttggacatggcaagaggcatggcttttcttcatacactagagcctctcatacctcggcacgcactcaatagccgtagtgtaatgatcgatgaagatatgactgcccgaatcagcatggctgatgtaaagttttctttccagtgccctgggcgcatgtatgcacctgcctgggtggcccctgaagccctgcaaaagaagcctgaagatacaaacagacgctcagcagacatgtggagttttgccgtgcttctgtgggaactggtgacacgagaggtgccctttgctgacctttctaatatggagattggaatgaaggtggcactggaaggccttcggcctactatcccaccaggtatttccccccacgtgtgtaagctcatgaagatttgcatgaatgaagaccctgcaaagcgacccaagtttgacatgattgtacctatcttggagaagatgcaggacaagtag

SEQ ID NO: 2519 - DNA, 1803 bp, Rattus norvegicus
  Genbank Accession No. NM_133419
gtcccggcggcgcgtggtgaccgttggcgtgcgcggttctcggctcgcggcggcggttagcggcggttggccgggttgtctgcctgcgacatggcggacgcggaagccgccatgacgttcccgaagaagcacaagaagaagaaagagcggaagccgctgccggaagctgacgtggctgagatccagcacgcggaagatttcctgatcaaaccggagtccaaggcggctcagttggacacctcccagtggcccctgctgctcaagaactttgacagactgaacgtgcggacgacccactacacgcccatcccgtgcggctccaacccgctgaagagggagatcggggagtacgtcaggaccggcttcatcaacctggacaagccatccaacccctcttcgcacgaggtcgtggcctggatccgccgcatcctgcgcgtggagaagacggggcacagcgggacacttgaccccaaggtcaccgggtgcctcatcgtctgcatcgagcgcgccacgcgcctggtcaagtcacagcagagcgcgggcaaagagtatgtcggggtcgtgcggctgcacaatgctatcgaggggaccgcccagctctccagggccctggagaccctgacaggcgccctgttccagcgtcccccgctcatcgcagcagtgaagcggcagctgcgcgtgcgcacaatctatgagagccgtgttgtcgagtatgaccctgagcgcaggctgggtgtgttctgggtgagctgcgaggctggcacctacatccggacgctgtgcgtgcacctggggctgctgctgggcgtcggggggcagatgcaggagctgcggcgcgtgcgctcgggggtcgtgggcgagcgggaccacatggtgaccatgcacgacgtcctggacgcgcagtatctatacgaccaccaccgggacgagagctacctgcgccgcgtggttttcccactggagaagctgctgacgtcgcacaagcgcctggtgatgaaggacagtgcggtcaacgccatctgctacggcgcgaagatcatgctccccggcctcctgcgctacgaggacggcatcgaggtcaaccaggaggtcgtggtcatcaccaccaagggcgaggccgtctgcgtggccatcgcactgatgacgacggctgtgatctccacgtgcgaccacggggtagtagcgaagatcaagcgcgtcatcatggagcgggacacctacccccgcaagtggggcctggggccgaaggcaagccagaagaagcagctgatcaagcagggcctcctggacaaacatggccgacccacggacggcacccccgcctcctggacgcgcgactacgtggactacagtgactccagcaagaaagcgacggccgccgaagccacgccgggccctggggtcaccgcggacgccgccagcatcgtgaaaaggaaacgcgatagcgacagcgacgccgacgaggcgacgcccactaccacgccccgggtgaagaaggagaagaagaagaaaaaggagaaggcggacggcggggaggaggctgcggaggacggggacggcgacgccacaaggaagaaaaagaagaagaaggcaagggcggcagaggagctcagtggttagcgactacccccgacccccacgcggcgaccatcccgtcctgttttaaggacgcgaggcgtaggaacggggtctccaccactgacccctccactcacttgagcccccgacgaccgcccgcggcgattcgccggaggccatgttgagcgacaccgcagacggccctggcctgccctccattttttt

SEQ ID NO: 2520 - DNA, 2968 bp, Rattus norvegicus
  Genbank Accession No. NM_133423
atggcggccgacagccgggaggagaaagatggggaacttaatgttttagatgatattttgactgaagtaccagaacaggatgatgaactgtataatccagagagtgaacaagataaaaatgagaaaaaaggatcaaaaagaaaaagtgaaagaatggaatctattgacaccaagcgacagaagccttctatccattcaagacaactgatttctaagccactaagctcatctgttagcaataataaaagaatagttagtacaaaaggaaagtcggttacagaatataaaaatgaggaatatcaaagatctgaaaggaacaagcgtctagatgctgatcgaaaaattcgtctgtcaagcagttcctctagagaaccttacaagagtcaaccagaaaaaccttgtctacggaaaagggattctgaaagaagggccaagtctcctacaccagatggttctgagagaattgggcttgaagttgatagacgtgcaagcagatccagccagtcttcaaaggaagaggggaactctgaggagtatggctctgaccacgagacaggaagcagtgcttcttctgaacagggcaacaacactgagaatgaggaggaaggaggggaagaagatgtagaggaagatgaagaggtagatgaagatggagatgatgatgaggaagtggatgaagatgcggaggaggaggaggacgaggaagaagatgaggaggaggaggatgaggaagaagaagaggaagaggaagaagaatatgaacaggatgagagagatcagaaggaagaagggaatgattatgacacccgtagtgaggccagtgattctggttctgagtctgtttccttcacagatggatctgtcaggtctggttcaggaacagatggatcagatgagaaaaagaaggaaaggaagagagctcgaggcatatcacccattgtctttgatagaagtggcagttctgcatcagagtcatatgcaggttcagaaaagaagcatgagaaattatcatcttccgttcgtgctgtccgaaaagatcaaaccagtaaactcaaatctgtccttcaggatgcaagatttttcctcataaagagtaacaaccatgagaatgtgtctcttgccaaagcaaagggtgtatggtccacattacctgtaaatgagaagaaattaaatcttgcgtttagatctgcaaggagtgttatattaatattttctgtcagggaaagtggaaagtttcaaggttttgccagattgtcatcagaatcgcatcatggtggctctcctatacattgggtgcttccagcaggaatgagtgctaaaatgcttggaggtgtttttaaaattgactggatttgcaggcgtgaattaccctttactaagtcagctcatctcaccaatccctggaatgaacataagccagtaaagattggacgtgatggacaggaaattgaacttgaatgtggaacccagctttgtcttctgtttccccctgatgaaagtattgacttgtatcagctcattcataaaatgcgtcacaagagaagaatgcattctcagcctcgatcaagaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccccgataccaggaagttgacagtttcacaaatcttattcccaacagacgattttcaggagttcgccgagatgtgtttttaaatgggtcctacaatgattatgtgagggaatttcataacatgggaccaccgcctccttggcaaggaatgcctccttacccgggaatagaacagcctccacaccatccctactaccagcaccatgccccgcctcctcaagcccaccccccttactcaggacaccatccggtaccacatgaagcaagatacagagataaacgagtacatgactatgatatgagggttgatgatttccttcgccgcacacaagccgttgtcagtggtcggagaagtagaccccgagaaagagatcgggagcgagagcgagaccgccctagagataacagaagagatagagagcgagacagaggtcgtgatcgagaaagagagagagaaagaatatgtgatcgggacagagaccgaggggaaagaggtcgttatcgaagataatgtgctttttggaagcactgactgaagataaaaaatattgtattttttttgtgtgtgtttacaagtagtaaatttattttcagctgtctacttaaagctcattgtgtagaaggatttattatcttctttgttccaagcatgcagtagaataagaactggaaaactcagatccgccaaaaaatgcacagttgacagttgagttgacacttttattggggcagaatggaacagtccaagaatgtagatattgattcattctccataaatgttctttttacagtgtattcatcctagagttattttgtttgtttgttttccttcttttggaccttggtcaatactgccatagtattttgctttgtgtttctataggtagctgcacacggttcagtaaaaataatgctgctatcaagtatgcagatattgagtatgatggtttgactatatggcagtgttgtagcagcctctcggtttctcctcttccctccttttttttaaacctataaatccactttttttttaagtcttcaatgatgagagcaatattaagaagacattgctatctaatttttaatctttttaaataaaacgttcctatgttcagtagcatggtcgatgctattgtttagccttccttccaaactgtacattggcttggaatgttcagttttgcgtgtgtggcagcagaagataaccccacattctacattgctactgttttgtatgaaataaattggtaaagattgacact

SEQ ID NO: 2521 - DNA, 2681 bp, Rattus norvegicus
  Genbank Accession No. NM_133511
gcgcctcgctccgattcccggctgcgactggcggaggctctggagcaacgcggtcccggtgtgcaatacgcacacgccgcggcgcagggacacagacccgactgcccgcggtcacacgcaccgagagaccaggctcggcgcgcgctccgcggcgcacacgctccagccggtgcggctctgggcgcggattcgcgggttgcgcgccctcctgcacattcagtcccggcgcccagcagtctggaccggcccggagaccagcagcgagtggacagtggcaggcggcgactgaatctccaagtctggaaacaatagccagagatagtggctgggaagcaccatggccagagtcctgcagctctccctgactgctctcctgctgcctgtggctattgctatgcactctgactgcatcttcaagaaggagcaagccatgtgcctggagaggatccagagggccaacgacctgatgggactaaacgagtcttccccaggttgccctggcatgtgggacaatatcacatgttggaagccagctcaagtaggtgagatggtccttgtaagctgccctgaggtcttccggatcttcaacccggaccaagtctggatgacagaaaccataggagattctggttttgccgatagtaattccttggagatcacagacatgggggtcgtgggccggaactgcacagaggacggctggtcggagcccttcccccactacttcgatgcttgtgggtttgatgattatgagcctgagtctggagatcaggattattactacctgtcggtgaaggctctctacacagtcggctacagcacttccctcgccaccctcactactgccatggtcatcttgtgccgcttccggaagctgcattgcactcgcaacttcatccacatgaacctgtttgtatccttcatgctgagggctatctccgtcttcatcaaggactggatcttgtacgccgagcaggacagcagtcactgcttcgtttccaccgtggagtgcaaagctgtcatggttttcttccactactgtgtggtgtccaactacttctggctgttcattgaaggcctgtacctctttacactgctggtggagaccttcttccctgagaggagatatttctactggtacaccatcatcggctgggggacacctactgtgtgtgtaacagtgtgggctgtgctgaggctctattttgatgatgcaggatgctgggatatgaatgacagcacagctctgtggtgggtgatcaaaggccccgtggttggctctataatggttaactttgtgcttttcatcggcatcatcatcatccttgtacagaagctgcagtccccagacatgggaggcaacgagtccagcatctacttcagctgcgtgcagaaatgctactgcaagccacagcgggctcagcagcactcttgcaagatgtcagaactatccaccattactctacggctggcccgctccaccctactgctcatcccactcttcggaatccactacacagtattcgccttctctccagagaacgtcagcaagagggaaagacttgtgtttgagcttgggctgggctccttccagggctttgtggtggctgtactctactgcttcttgaatggggaggtacaggcagagattaagaggaaatggaggagctggaaggtgaaccgttacttcactatggacttcaagcaccggcacccgtccctggccagcagtggagtaaatgggggaacccagctgtccatcctgagcaagagcagctcccagctccgcatgtccagcctcccggccgacaacttggccacctgaggcctgtctccctcctccttctgcacaggctggggctgcgggccagtgcctgagcatgtttgtgcctctcccctctccttgggcaggccctgggtaggaagctgggctcctccccaaaggggaagagagagatagggtataggctgatattgctcctcctgtttgggtcccacctactgtgattcattgagcctgatttgacatgtaaatacacctcaaatttggaaagttgccccatctctgcccccaacccatgcccctgctcacctctgccaggccccagctcaacctactgtgtcaaggccagcctcagtgatagtctgatcccaggtacaaggccttgtgagctgaggctgaaaggcctgttttggagaggctggggtagtgcccaccccagcagcctttcagcaaattgactttggatgtggacccttctcagcctgtaccaagtactgcagttggctagggatgcagctcagtttcctgagcatcctttggagcaggtcaacctgaggctccttttgcttacccgacatctaagttgtccaggtgctcggctcctgtgtgcctggatgacgggagggctccggggtctttcagtcaaagacttacattgaggtggggtgagagtcagagaaaagttctggtgcttttcatttgttctaagagctgagagccaggaatgcagagtcaattgggaaggagatgggatagctgatgatcttaccatgtccatgactgtgcccctgattcaagaccggatcatgtggtggctttatttctacacttcttgtccacaatggacagtctgaggaagctcttctttcagccacaacaaccacagaaagccctttct

SEQ ID NO: 2522 - DNA, 2106 bp, Rattus norvegicus
  Genbank Accession No. NM_133524
tggtgtcactacacagggctgcctctaggcctggggaacgcaccccagttccgacacctgctgccctggctggatgatgaaccagtctcagagaatggcacctgttggctcggacaaagaactgagtgacctcctggacttcagtatgatgttcccgctacctgtggccaatggcaagggccggcccgcctccctagctggaacccagttcgcaggctcaggactggaggaccgacccagctcagagtcctggggcaacagtgaacagaacagttcttcctttgaccctagccgggcatacagcgaaggtgcccacttcagtgactcccacagcagcctgccgccttccacgttcctaggagctgggcttggaggcaagggcagtgaacggaatgcctatgccaccttcgggagagacaccagtgttggcaccctgagtcaggctggcttcctaccaggtgagctgggcctcagcagtcccgggccactgtccccatcaggcgtcaagagcagctcccagtattacacctcattccccagcaaccctcggcggagagctgcagatggtggcctggatactcagcccaagaaggtccggaaggttccgcctggtcttccttcctcggtatatccatccagctcaggtgataactacagcagggacgccacagcctacccctccgccaagacccccagcagcgcttacccctcccccttctacgtggcagacggcagcctgcacccctcagcggagctctggagtccccctggccaggtgggctttgggcccatgctaggtgatggctcggcccccctgccgcttgcaccgggcagcagttccgtgagcagtggtgcctttgggggcctccagcagcaggatcgcatgggctaccagctgcatgggtctgaggtcaatggtacgctcccagctgtatccagcttctcagctgcccctggcacttacagtgggacttctggccacacgccacccgtgagcggggccgacagcctcttaggcacccgagggactacagccagcagctcaggggatgcccttgggaaggcactggcctccatctactccccggatcactccagcaataatttctcgcccagcccctcaacgcctgtgggttcaccccagggcctgccagggacatcacagtggccccgggcaggagcgcccagtgccttatcccccaactacgatgcaggtctccatggcctgagtaaaatggaagatcgcttggacgaggccatccacgtcctccgcagtcacgctgtcggcactgcaagcgagctccatggactgctgcctggccacagcacgttgaccacaagctttgcgggccccatgtcactgggcgggcggcatgcaggcctggtcagcggaagccaccctgaggatggcctcacaagtggtgccagtcttttgcataaccatgccagccttcccagccagcccagctccctccctgacctctcacagaggccacccgactcctttagtggactcgggagggcaggcgtgactgcaggcgccagtgagatcaagcgggaggagaaagaggacgaggaggtcacatcagtggcagacgctgaggaagacaagaaggacctgaaggtcccacgcacacgtaccagcccagacgaggacgaggacgaccttctccccccagagcagaaggccgagcgggagaaggagcgccgggtggccaataacgcccgagagcgcctgcgtgtccgcgacatcaatgaggcctttaaggagctcggccgcatgtgccagctgcacctcagcactgagaagccgcagaccaaactgctcatcctgcaccaggccgtggccgtcatcctcagcctggagcagcaggtgcgagaacgcaacctgaaccccaaagcagcctgcttgaagcggcgggaggaggagaaggtatctggcgtggtcggggatccgcagctggcgctgtcagccgcccacccgggcctgggtgaggcccacaatccagctgggcacctgtgagccgtcacagggtcttcgttggaccagggaccaccacatctctgcccggggtgcacccaggatggtcctggatgagacatctc

SEQ ID NO: 2523 - DNA, 1182 bp, Rattus norvegicus
  Genbank Accession No. NM_133526
acttgcctgaagataacgtttgggatatttaaaggtgtgggttaattttttatccattttagtaactgggttttttttttttctttccgactacttccttgctttctattgctacccgaagctgcaggcacacggatctctgcaggcaaaatccctcagagccttcgcaggacagcctggtaacgactggttcgtcctactgtaactgggtggctgccccttctccgaaatggcaggtgtcagtggctgtttaaagtattcgatgtttttcttcaacttcttgttctgggtatgtggtacactgatcctgggtctagccatatggttgagagtaagcaaagacggcaaagagattatcacatccggtgacaatggcacgaaccccttcattgctgtgaatatcttgattgcagttgggtccatcatcatggttctgggtttcctgggatgctgcggagctgtgaaagaaagtcgctgcatgcttctcttgttttttatcggcttgctcctgattctgcttctgcaagtagccgcaggtatcctaggagctactttcaaatctgaatctagccgcattctgaatgaaacgctctatgaaaatgccaagcttttgtcagaaacaagcaatgaggcaaaagaagtacagaaggccatgattgcatttcagtcagagtttaagtgctgtggcttgagatttggagctgctgactggggaaaaaattttccagatgcgaaagagtcatgccaatgtacaggatctgattgtgaaagttataatggagagaatgtctatcgaacgacctgtctttctctgataaaagagctggttgaaaaaaacattattattgtcattggaattgcctttggactggcagttatcgagattcttggtttggtgttttctatggtgctctactgccaaattggaagcaaatgaatctgcggacttcctcagtcgttatagacaccatttaagtttttgctttggcttcgtaactttaaatactcgagtactgtacataccaggagcagatgtcttcttgatgagctctcacttaggcagactacaggtatcttcacatgtactcagctcatttaactgtgaaggacataataaaagtggtcgtgtatttttttttctcacaataaaaagtgttcgtgctgaaaaaaaaaaaaaaaaaa

SEQ ID NO: 2524 - DNA, 2513 bp, Rattus norvegicus
  Genbank Accession No. NM_133528
tggcactatggtcatggcggaggggacggcagtgctgaggcggaacaggccaggcaccaaggcgcaggatttctataattggcctgatgaatcatttgatgaaatggacagtacacttgctgttcagcagtatattcaacagaacataagggcagactgctccaatattgacaaaattcttgaaccacctgaaggtcaagatgaaggtgtatggaagtatgaacatttaaggcaattctgccttgaactaaatggacttgctgtcaaacttcagagtgagtgccatcctgatacttgtactcagatgacagcaactgaacaatggatttttctttgtgcagctcataaaactccaaaagagtgtcctgccatagattatacaagacacacactggatggtgctgcatgtcttctgaatagcaataaatattttcccagcagggttagcataaaagaatcatctgtagcaaaactaggatcagtgtgccgtaggatttacagaatattctcacatgcctattttcatcaccggcagatatttgatgaatatgaaaatgaaacatttttatgtcaccggtttaccaaatttgtgatgaaatataatttgatgtcgaaggataacctgattgtaccaattttagaagaggaagttcagaattcagtttctggggaaagtgaagcatgaaggaatcatgtagaacaatgtactgatcacataattaacaattatgtactgtatatatatcattttagacacatcaatcatgtatccatattatagcttatttgtttagtataggtttttgtatgctatgtgttgcctttttaaatgggaaatacattttaagttattcatgagctgtatattcactggtgtggcactcatggtttttaaataagtttagtattatctgtttataatgcctgttaataaaagaatttacagtttggtataattgctgctaaacaatcattggatcacaatcctctcaaatctataaaggaatgaacttgtgtctcacacaagtatttacaattactaaagagaatattttgttttcacccctaagatttaatattttaggaaattcagtagtattccatctgtactgttaatttttccaaaatgagataaaagtgtttaagagttctgtttatagcttttgatatgcataactgattatgtgtgtgttcagagaaattcgaggaggtgttagtaataaattatctctctcttctacataaagtatcctttaggtcagtgtacatggaagcattacctttgctatggcagtgcattattaaatacatggtgaggaggaggaggcacatacatgatgttcccatggacacccacccgccccttgtttcccttagtcctctgggaagtatactagtcatgaaatttacttaccaagctatggttagtggtggcttttccctatttatactgtattaattgcttacagagcatacctcatactagcagtgacgttacactacagggaaactggactgcctacctttgttttttaaaatggttgtaactacttagaaaatagtccttaatatagtttgacttttcctgttagtaatattaatcttttcacctagccctaggcagcattaaatagatatgaaaaaaaagatagtgtatttattttattctccctccttaaaagcttattgttctaattatatgcacatgtaagactatttacaataattcacaggttaagtgctgttgataagtggtcatactttgatttcttatttcagtgtcttaagaatttaagtgcagacttagataacatgattggtggagtttctctttaaacactgaggtctctatgccacactgtagcaaggcactgagatgaaacagagacctgtgcagttgggacaattgaagccatcttttccaatttaataaacacaagaaacttcttttttatttaagagctatttgcaaatgaaattgaaaaatgcattcatcttgtttgtttttctaattatttgaagaaatgatttgtattgtattataagacaagtatacacagaaaaattgggaagtgagagcaaactgagagtgtgtgtatagttgacgcctgtctgaacctgtgctgtgccagcggtcacagtcatcactgtacctgagcccacagttatcttctgagaagttcatgtatgcagtgaatagaacattgactgaaattgggtgtttatattactgtcaccataaatcattggggttagtaattttaataaacttggtagatatgagagactaacctatactaagttcataaattatacatagcctagtaatgttgctgttctctagttggagtccccggtggagtcctgttgtttgacttgctcagtgagcagttaaggcaggtggagacctgactgagtacttggaacactttgtgaatatatggcttagtgttaacaggaaaataaagtgtggttttctttttatacttactccaaaaaaaaaaaaaaaaaaa

SEQ ID NO: 2525 - DNA, 6878 bp, Rattus norvegicus
  Genbank Accession No. NM_133541
gccggggctgctaactgaagaggccatggacgcgctcgagtcgttgttggacgaggtggccctggaggggctcgacggcctgtgcctgcccgcgctgtggagccgcctggaatcccgctcgcctgccttccctttgccgctggaaccctacacgcaggagtttctgtggcgggccttagtcacgcacccgggcatcagtttctacgaggagccgcgagagcgacctgacctgcagctccaagaccgatatgaagaaatcgacttggaaactggaattttggagtccaggagggacccagtcactctggaagatgtctaccccattcatatgatcttagagaataaggatggcatccagggctcctgccgatactttaaggagagaaaggacatcaccagtagcatcaggagcaagtgtttgcagcctcgttgtacaatggtagaagccttcagcaggtggggtaagaagctcatcattgtggcttcccaggacatgcgataccgggccttgataggcctagagggggatcctgatctgaagcttcctgatttctcctactgcattttggagcggttaggtcgatcgagatggcaaggggagctgcaacgagaccttcacaccaccgctttcaaggtcgacgctgggaagcttcattatcacaggaaaattttgaacaagaatgggctcattacaatgcagtcacacgtgatccgactgcctactggagcccagcaacactccatcctcctcctccttaaccggtttcatgtagacaggaggagcaagtacgacatcctcatggagaagctgtctatgatgctgagcacacggagcaaccagatcgagactctgggcaagctgagggaggagctgggactgtgtgaaaggacgttcaagcgtctgtaccagtacatgctgaatgctgggctggccaaagtggtgtcccttcccttgcaggagattcaccctgagtgtggtccctgtaagaccaagaaagggactgatgtcatggttcggtgccttaagctcctgaaggagttcaggcgaaagatggaagacgaccatgacgacgatgacgatgaagaggccatctccaaggctgtacctcccgtggacatcgtgtttgagcgggacatgctcacgcagacctacgagctcattgagcgcagaggaacgaaaggaatttcccaagctgagatccgagttgctatgaatgtgggaaaactggaagcaagaatgctgtgtcggctccttcagaggttcaaggttgtcaagggattcatggaagatgaaggccggcagaggaccaccaagtacatttcctgtgtatttgcggaggagagtgacttgagccgccaatatgcgcgtgaaaaggcccgaggagagctgctaaccactgtgagcctcgcctcagtgcaagatgaatccctcatgcctgagggtgaagaggccttcctctctgactccgaaagtgaggaagagagcagctgcagtggcaagcgtaggggccgagggtcccgggggcattcaagagcctctggggatgctgggcctggctctcggcctcatcactccactccagccaagggcgggtggaaagtcctaaatctgcacccattaaagaagcccaaaagtgccgctgtggaaagatcccgccgaagctctgcttgtagggatggcctggacaccagcagctcatccgagctcaatataccctttgaccctcacagcatggacagtcacagtggtgacatcgctgtgattgaggaggtccggcttgataaccccaaggagggtggtggctcccagaagggcggacggcatggctcaggccaggacaagcctcacaaaacataccgactgctaaagcgcagaaatctgattatagaagctgtcaccaacctccgcctgattgagagcctgttcacgattcagaagatgatcatggaccaggagaagcaagagggtgtctccaccaaatgctgtaagaagtccattatccgcttggtgcggaacctgtctgaggagggtctcttgagattgtataggactacagtcattcaagatggcatcaagaagaaggtagacctggtcgtgcacccttccatggaccagaatgaccctcttgtgagaagtgctattgagcaggttcgcttccggatctccaactcaagcacagcaaacagggttaaagttccaccggccccagcaccccaagaggaagcagaagagggaaaccaagaaccagaggtcccaagtagatcagcagactctgaagcgaacacatcctcgaagccagaaagcacacgggtgaaaaagacagatgagaaaatgggcataaccccactcaagaattacaaacctgtcatagttcctggacttgggcgctccatagggttccttcccaagatgccacgccttcgggtgatgcacctgttcctgtggtacctggtgtatgggcatcctgccagccacactggggaacagcctactttccacagtgagaggaaaacaggcaagcaggagcccagcagaccaggggtccagccctcctcaggagatgactgggactcctctgaagccaaaaacagcacagaaagcagctcctgggaggcagaaatggaactctccacagagagagtgtatgtggatgagatctcatggatgcgctacgtccctcccatccccatccacagagacttcggctttggctgggctcttgtcagtgacattcttctctgccttcccctctccatctttgtccaagttgttcaagtcagctacaaggtggataacctggaggattttctgaatgaccctctgaagaagcacacactgatccgcttcctccctaggcacatccggcagcagctactgtataagaggcggtatattttctcggtggtggagaacctgcaacggctgtgctacatggggctgctacagtttggacccacagagaagtttcaggataaagaccaggtctttgttttcctgaagaagaatgcagtcattgtggacaccaccatctgtgacccacattacaacctggcccacagcagccggccttttgagagacgtctctacgtcttggattccatgcaggatgtggaaagctactggtttgacctgcagtgtatctgcctaaacaccccactaggtgtggtgcgttgtccatgtgcacagaagatctgccctgatccgggcagtgacccagaaggcagcttgcggaaggagcaagagagcgccatggacaagcacaacctagagcgcaagtgtgccatgctggagtataccacggggagccgagaagttgtggatgaaggcttagtccctggggatggactgggagctgctgggctggactctagcttctatgcacacctgaagcgcaactgggtctggaccagctatatcatcaacaaagccagaaagaacaacacctccgaaaatgggctcacaggaagactccagactttcctgtctaagcgcccaatgccacttgggtctggaggcagtggccgtctgcctctctggtcagaggggaaagctgatgctgagctctgtgctgacaaagaggaacactttgaactggaccgagaacctacccctggcaggaaccgaaaagtgcgtgggggcaagagtcagaagcggaagcggctgaagaaggagcccatcaggaagaccaagcgaaggagaagaggagagcatccagaagccaaaagcaaaaaactacgctaccaagatgaggctgaccagaacgccctccggatgatgacccggcttcgggtttcttggtccatgcaggaggatgggttactaatgctctgccgaattgccagcaatgtcctcaacaccaaggtgaaaggaccatttgtcacctggcaggtcgtgcgtgacattttgcatgctacctttgaagagtctttggataaaacatctcactcggttggacgaagagctcgctacatagtcaaaaatccccaggcctttatgaactacaaagtctgcctggcagaagtgtaccaagataaggcactcgttggagatttcatgagtcggaaggataactacgaagacccaaaggtctgtgccaaggagtttaaagaatttgtggagaagctgaaagagaagttcagctctggcctgaggaaccccaaccttgagatcccagacacactgcaggaactctttgccaaataccgggtgttggcaatcggagatgaaaaggaccgtgtcaggaaggaggatgaactgaatagtgtggaggacatccacttcctggtgctacagaacctgatccagagcacactgtccctctctaacagccagtccaactcttgccagtccttccagatcttccgcctctaccgggagttccgggagcctgtgctggtgcgggccttcatggagtgccaaaagaggagcctggtcaaccgacgccgtgtcagccactcccagggtcccaagaagaaccgtgctgtgccctttgtgcccatgtcctaccagctctcccagtcatactacaagcttttcacctggcgatttcccaccaccgtctgcaccgaatccttccagttctatgacagactacgggccaacggcatactagaccagcctgatcatttttctttcaaggacatggatagcaatgacccttcaagtgacctggtggcgttttctttggacagccctggaggacactgtgtgacagccctggccctcttctccttgggcctcctctctgtggatgtccgaatcccagagcagattgtggtggtagacagctccatggtggagagtgaggtcatgaagagcttggggaaagatggcggcttggatgatgatgatgaggaggaagacctggatgaaggttcagggaccaagcgtcagagtgtggaagtaaaggcccatcaggcctcacacaccaagtacctgctgatgagaggttactacacagtgcctggcatggtcagcacgcgcaacctgaaccccaatgacagcattgtggtcaattcctgccaggttaaattccgactgcgcaatacccctgcacccacccatcttgggcccactgggcccacagccacaccgctagaagagctccaggctggcccttcctgcctccctgcctcctttaccagcctggtggatccacagctgcacacccgctgcccagaagagtttgcccaccagatggcacagtctgggtacagccctgaggacgtggctgcgtccctagagatcctgcaggctgtggcagctgctgactgcttcggggttgacagggagaagctgagcagacagttctctgccttggagaagatagcggacaagcgcaccaggacgttcctggactatatccaggacctcttggaacagcaacaagtcatggaagttggaggcaacactgtgcgcctagtggccatggcctctgcccagccctggctcctgccttcagtgcgtctgaaagatgtggaaatagacaccaaggcctcaggggatgacagccaatctagactccctgcggggtcttccatcgaagaccacacctctgagggtgcaccaattcctccagtcagctccaatggcactaaaaagcgcccctactgctctattcagagccctgaaactgatgctgaggaagctacaaggctccctgccaagaagcccacattacaagatgtctgtgtggctgccagtcctaggcctggaacagaagagcagacagaggcccaggctcagtttgcagctcctgaagatgcaggtgcagagggccccaggcaggagagccaagagagtgttggtgtctcaggcctagagcagctgggctgtgagttccagcttccagaaaattctgaagaccccagaggacttacagagagcaacatggcccaggtagcatgggagagcggctgtgaaagagtatgttttgtcggtcgcccatggcgtggtgtggacgggcgcctgaacatgcccgtgtgcaaaggcatgatggaagccgtgctgtaccacatcatgtcaaggcccggtgttcctgagagctgcctgctacagtactaccagggcgtcctacagcctgttgctgtgcttgagctgctccggggcttagagtctctcggctgtatccagaagcggatgctgaagaagccagcgagtgtctcactcttctccaggcctgtggtggagggcctaggtcaggccagtgaggccgaggcactctcctgtcaggggagcactgtcaccttttatgaacctactctggactgtaccatccgtctgggccgtgtcttcccccatgacatcaactggaaacaaagtggatccatttatagatgcgtcccaggccagcagaggagcctctgcccgtgcttaattgttccgcctggactgtcccaagagccccgtccttcacacagctgttaccagagctcggcccagcctagcacaggtgtagcaactagcaggtgacttcagtcccctctgctctcggctgctcttggtcccaggtgcccagccttcctgcagccctgtgtcctgccctggactcaggctctagcatcagcagtatctgcaagggatgttgtttagggagcaggctgatgaccaagccctgagtcacctcacacgcaccacaccattcagactcagaggaagacacatcacaggtgtacctggcagagtctgctcctcttaaggtagggcatcccaacttggcctgaactgagctcaggtctccagctcccaagggcccctcccgccagaagcaaggcctgtaggttttgcttttgtttttgttttattttgcgctcttttcactagatacaagcccctggcatgtatttatttattttttaattaaagtaagatgaaatgc

SEQ ID NO: 2526 - DNA, 5543 bp, Rattus norvegicus
  Genbank Accession No. NM_133545
cgggcgagcgctagcggccgcggcggccgcgcggaacccagggaggcgggacgcagagccggagcgcggccccgaccaggcgggagcccgagcagcgctggcgtggatgctccccatcgcttggtcgttggagactcggttgctttttaatggcagcagcggctgttggatgactagagtttgttttgactggagggtcgcttttgcttggcactataactgctggattggtccttcctggcccttccactgttgaagggagaagatgccactgccatttgggttgaaattgaaacgcacccggcgctacactgtgtccagcaagagctgcctggttgcacggatccagctgctcaataatgagtttgtggagttcactctgtccgtggagagcactggccaggagagcctagaagctgtggcccaacgcctggagctgagagagatcacgtacttcagcctctggtactacaacaagcagaatcagcgtcgctgggtggatttggagaaacccctgaagaagcagctggacaagcacgcgctggagcccaccgtctactttggagtggtgttttatgtgccctctgtttcccagctgcagcaggagatcaccaggtaccagtattacctgcagctgaagaaggatgttctggaaggaaaccttccctgcacattggagcaagccattcagctggctggcttagctgttcaagctgattttggcgactttgatcagtatgaatcccaagattttcttcagaaattcgccttgctccctgtggggtggctacaggatgaaaaactgctggaagaagcagcccaaaaagtggccttgctgcatcagaaatacagagggctcacagctcctgaggccgagatgctgtacatgcaggaggtagagcggatggacggctatggagaggagagctaccctgccaaggacagccaaggaagtgacatatccattggtgcttgtctcgatggcatctttgtgaagcacaagaatgggaggcctcccgtggtgttcaggtggcacgacattgctaacatgtcacacaataagtccttttttgcgttagaactggcaaataaagaggagaccatccagtttcaaactgaagacatggaaacagcaaagtacgtgtggaggctgtgtgtggcacgccacaaattttacagactgaaccagtgtaacctgcaaactcaggctgccacgttgaactccgtcaggaggggctcatcgtccaggatgtctctgcctaaaccccagccctatgcgatgcctcccccaccccagctgcattataatggacattatacagagccatttgcttcttcccaagacaatgtctttgtgcccaacaagaatggattctattgccactcccagacaagtttggacagaacccaaattgacctcagtggccgcatccgcaacggcagcgtgtacagtgcacacagtacgaactccttaaacacacctcagccctacctgcagccctcccctatgtcctccaaccccagtattccaggcagcgatgtcatgagacctgactacatcccatcccaccggcacagcgccttgattcccccatcctaccgcccgacccctgactacgagagcgtgatgaagcggctcaacagaggcatggtgcatgcagacaggcatagccactcgctcaggaacctcaacattggcagttcctatgcatacagcaggcccgacgccttggtctacagccagcctgagattcgggaacacccacacctcgcctctccccagtcagcccactacccatttaacttgaactacagtttccacagccaggctccgtatccataccctgtggagaggcggcctgtggtgggcgctgtgagtgtccctgagctgaccaatgtgcagctgcaggcccaggactacccagctccaaacattatgaggacccaggtgtaccggccgcccccgccatatccttacccaagacctgccaacagcaccccggacctatcgcggcacctctacatcagcagcagcaatccagatctcatcaccagacgcgtccatcactcggtgcagaccttccaggaggacagcttgcccgtggctcactctctgcaggaggtgagtgagcccctcacagcagctcggcatgcacacctacagaagaggaacagtattgaaatcgcagggctcacacatggtttcgaaggcctgaggctcaaggaggagacgatgtcagcctcagccgcagacgtggctcccaggaccttctcagcaggctcccagtccagcgtcttctctgacaaagtgaagcaggagggaaccgaagagcaggggagtggtgggtacagtcacaagaagtccctttctgatgccaccatgctgattcacagcagcgaggaggatgaggacttagaagacgacagcagcagagaacacgctgtgtctgagccccgccttacggctgctttctctcaggaacaacagctaaactacccctgtgcttcagtgactccggtcactggccctctgcatattttcgagcccaagtcccatgttacggagcctgagaagagggcaaaggacatcagccctgtccacctggttatggagactcatcagccccgaagacatggactgctgaccccctccatgtccgagtcagacctcacgacgtcagggaggtaccgagctaggagggactctctcaagaagaggccagtgtcagatctcctctctgggaagaagaacactgtggaaggacttccgccactagggggaatgaaaaagactcgagcagatgcaaaaaaaattggccccctcaagctggcagccctcaatggactctccctgtcccggctgcccctgcctgacgaaggcaaagaagtgtccaccagagcgacaaatgacgagaggtgtaaagttctggagcagcggttagagcaaggaacggtcttcaccgagtatgagaggattctgaaaaagcggctggttgatggcgagtgctcaacagctcggctccctgaaaatgcagagagaaaccgattccaagatgtgctcccctacgatgatgccagagtggagttggtgccaaccaaggagaacaacactggctatatcaatgcgtcacacattaaggtctctgtcagcggaattgaatgggattatattgccacacagggaccattacaaaatacctgccaggacttttggcagatggtgtgggaacagggagtcgcaattatagcaatggtgacagcggaagaggagggaggtcgggagaagagctttaggtattggccacggcttggctccaggcacaacactgtcacctatggaaggtttaagatcacaactcgcttccgcacggactcgggctgctacgccaccacaggtttgaagatgaagcaccttctcacagggcaggagaggacagtttggcatctccagtacacagactggcctgaacatggctgtcccgaagacctcaagggatttttatcataccttgaagagatccagtcagttcgacgtcatacaaacagtacaagtgaacccagaagtcccaaccccccgctgctggtgcactgcagtgctggcgtgggaagaactggggttgtcattctgtcagagatcatggtggcctgtctggaacacaatgaggtgctggacatccccagagtgctggagctgctgaggcagcagaggatgatgctggtgcagacacttagccagtacacgttcgtgtaccgggtgctcattcagttcctgaagagctctaggctcatctaagctccaccacctttctatggggacccaatcatgtgatgtgtttacagctttaaaaagaaaaaggaaagaaaagagtgcagctcccactttgttcccaggagtccatgtggagacctcaacaggaagtgtgtaagagctgaagaagctaagcatggggctgaggagtctggggacctgggagaggccgaggaggcaggtgctgccctggccacatctgcctggtttgctgcacttgcacaagttttggagattgtattttctagacagttctctgtcgtactgaagctgcctgggcagtcccagccagcacttaaggcacacagacttctatcttaaactcatatttgataatgcaattttatgactaaatagggttttttcttttttagctagaagctgaacttttctgtgggacatccacagaccgtgtggttcttgagtacctgtatttaaaaccattattagcttttgtttaagaacaaaaaccatgggggaactaagtgttttattcatgaaatccaaaactaaagaaaatctaaaagtgttattttgaaacatagaaagcatttttatattcagaatgtttttttaaaagttatatatttgtaccttctatattttccaaataagagctccattgttatgacactgagtcaatgtaaagttggggataaaggcacattatttaaaaatctaagaatcagattcactattttttcagtattattagtaagcgtaaaatgagtttgatttttttgaacatgaaagagcaattgcataggatggttttaagcacttttttgttaaaaatgagtttaatatatgtggctttatatttaagcaacagtggacactatttcaaagagaagggctctgagtacgttcgatgactaggggaagaggaagtgctctcggggctcacccggaaggtgtggtcattacacaaatgcagtattacctatgctcactcgagcgagagcgagagctgagatggcgtggaactcaaggcctgctaccgtgatgacgggctttgctgcctggggttcttcctgtctttcttccccccacagacaagtccaggcttacattaccattagagacccccgaagaggctttgtttcctttaggttgaaaggaggaaatagttaacgaggttcctttccctgaaccacagcccaaacttgtggggccaccagaaattgctgtggtgttcagggggtacttgaatttagcaccgtaatcctgtcctcccccagggtcagttctaggtactggtctccctttccatcccatttgggcacattctctattgatcagaacccaggcttgaagtggaaagtgctgttcttggaggacaagctggcacccttagctgaggtgtgtcatgttgtccagtgccctgcatcgtaggctgccgattcagtgtggacctagaatgttcgacctaggactagcttccaatactgtcctgccatcactctgatttgactttgtggtgagcgtcaccacatgacaggggtgtgccagcccatcgaagcaggacagacacaggtggattgtgccccagggtgggatttgtgtgctctatgctccatgtcaagccatgtgaaggtcaggacccttctgaagcttttcttccaatggtacgttgtttgaagatgctttcctgtcacacctaaacatttggaaatatcccactgacaagaacacattgtaaaacaaaactttaattaaagagtaatatatggca

SEQ ID NO: 2527 - DNA, 2225 bp, Rattus norvegicus
  Genbank Accession No. NM_133546
ctgcagtacttgtacattgctaaataaagagagggactccaggaggagcagcctgggtctaagaggtaggcagaaggaggttttaggggcctgagcacaagcttgaggagagaaaggttattaaaaagccagacgcttacaggtctcagaagggctagccagaaactgtggctggggttaaggaaagggtttaagagtgtgggcttttggttctgaggatgtagaacgtgaatgttgagagaagaaccaagtggcggagttgggtgtgagcaatgctattaggaatttgaggcagggattcacgcgctgctgtgactattttttaacaatgactcagtgctgtgacctgatactgtttccagagcgacttctaaacaaattccccctttctaggccagacacatggccccaagcccaagaccccagcatgtcctgcactggaaggaagcccactctttctacctcctgtctccactgatgggcttcctcagccgggcctggagccgcctgagggggcccgaggtctcagaggcctggttggcagaaacagtagcaggagcaaaccagatagaggctgatgctctgttgacgcctcccccggtctctgaaaatcacctacctctccgagagactgaaggaaatggaactcctgaatggagtaaagcagcccagaggctctgccttgatgtggaagcccaaagttcccctcctaaaacttggggactttcagatattgatgaacataatgggaagccaggacaagatggccttagagagcaagaagtggagcacacagctggcctgcctacactacagccccttcacctgcaaggggcagataagaaagttggggaggtggtggctagagaagagggtgtgtccgagctggcttaccccacatcacactgggagggtggtccagctgaggatgaagaggatacagaaaccgtgaagaaggctcaccaggcctctgctgcttccatagctccaggatataaacccagcacttctgtgtattgcccaggggaggcagaacatcgagccacggaggaaaaaggaacagacaataaggctgaaccctcaggctcccactccagagtctgggagtaccacactagagagaggcctaagcaggagggagaaactaagccagagcaacacagggcagggcagagtcacccttgtcagaatgcagaggctgaggaaggaggacctgagacttctgtctgttctggcagtgccttcctgaaggcctgggtgtatcgcccaggagaggacacagaggaggaagaagacagtgatttggattcagctgaggaagacacagctcatacctgtaccaccccccatacaagtgccttcctgaaggcctgggtctatcgcccaggagaggacacagaagaggaagatgacggtgattgggattcagctgaggaagacgcgtctcagagctgtaccaccccccatacaagtgccttcctgaaggcctgggtctatcgcccaggagaggacacagaagaggaagacgacagtgagaatgtggccccagttgactcagaaacagttgactcttgccagagtacccagcattgtctaccagtagagaagaccaagggatgtggagaagcagagccccctcccttccagtggccttctatttacctggacagaagccagcaccaccttgggctgcccctaagctgccccttcgactgcagaagcggctcagatctttcaaagcccccgcccggaatcagggccctgagattcctctgaagggtagaaaggtgcacttctctgagaaagttacagtccatttccttgctgtctgggcaggaccagcccaggctgctcgtcgaggcccctgggagcagtttgcacgagatcgaagccgctttgctcgacgcattgccaggcagaggagcagctgggtccttaccttacccctgctttcagggccagagcatggacacgccttagaaacctaccccttcctctgtcgtcctcgtctcttccactgcctgagccttgctcttccactgaggccacacccctcagccaagatgtgaccactccctctccccttcccagtgaaatccctcctcccagcctggacttgggaggaaggcgggctaagcctgagtagttttttgtgtattctatgagtgttagtctcttaatacgaatatgtaacgccttttgcatttgtaaaaaaaaaaaaaaaa

SEQ ID NO: 2528 - DNA, 2858 bp, Rattus norvegicus
  Genbank Accession No. NM_133551
gaattcggcacgagcggaactgtgaagggctcccatcaggctcccgactgacagagagctagaaggcacagagaaacctgaggattctcatttaactctgggaactgcttcaagaagctatagtaccagagaacacctgggaagtgtgagaattcctgcagctgggaccaaaatgtctttcatagatccttatcagcacataatagtggaacaccagtattcccataagtttacagtagtggttctacgtgccaccaaagtaaccaaggggacctttggcgatatgctggacactcctgatccttatgtggaacttttcatctctacaacccctgacagcaggaagcgaacaagacacttcaataatgatataaaccctgtgtggaatgagacctttgagttcattttggatcctaatcaggaaaatgttttggagatcacattgatggatgccaattacgtcatggatgaaaccctaggcacagctacatttcctgtatcttctatgaaggtgggagagaagaaagaagtcccttttattttcaaccaagtcacagaaatgattctggaaatgtctcttgaagtttcgtcatgcccagacctacggttcagcatggcactgtgtgatcaggagaaaacattcaggcagcagaggaaagagaacataaaagagaacatgaagaaacttttgggtccaaaaaagagcgaggggctttattccacacgtgatgtgcctgtggtggccattttgggttccggcgggggtttccgggccatggtgggattctccggtgtgatgaaggcgctctatgaatcagggattttggattgtgcgacctacgttgctggtctgtccggctccacatggtacatgtcaaccttgtactcccaccctgattttccagagaaaggtcctgaggagattaatgaagagctaatgaaaaatgttagccacaaccctctcttacttcttacgccacagaaagttaaaagatatgttgagtctttatggaagaagaaaagttctggccttcctgtcacctttactgacatctttggaatgttaataggagaaacactaattcaaaatagaatagtaccgaccttgagtagcttgaaggaaaaggtcagcgccgcccggtgtcctctgcctctcttcacctgtctccatgtcaaaccggacgtgtcagagctgatgtttgccgattgggtagaatttagtccatacgaaattggcatggcaaaatatggtacctttatgactcctgacctgtttggaagcaaattttttatgggaacagttgtaaaaaaatatgaagaaaaccccttgcatttcttaatgggtgtctggggcagtgccttttctatactgttcaacagagttttgggagtttctggcttacagaataaaggttctacaatggaggaggaattagaaaatattacagcaaagcacattgtgagtaacgacagctctgacagcgatgacgaggcccaaggacccaaaggcaccgagaatgaagatgcggaaagagagtaccaaaatgacaaccaagcaagttgggtccatcggatgctaatggccttggtgagtgactcagctttattcaatacccgagaaggacgtgctgggaaggtgcataacttcatgttgggcttgaatctcaacacatcgtatccactgtctcccctgagagacttcagcccccaagattccttcgatgatgatgaactcgacgcagcggtagcagatccagatgaatttgaacgaatatatgaaccactggatgtcaaaagtaaaaagattcatgttgtagacagtgggctcacgtttaacctgccgtatcccttgattctgcgacctcagagaggtgtggatctcatcatttcctttgacttttctgcaaggccaagtgacaccagccctccattcaaggaacttctgcttgcagagaagtgggctaaaatgaacaagctcccttttccaaagattgatccttacgtgtttgatcgggaaggattgaaggaatgctatgtgtttaaacctaagaatcctgatgtggagaaggattgcacaaccattatccactttgttctggccaacatcaacttcagaaagtacaaggccccaggtgttctgagggaaaccaaggaagagaaagaaatagctgactttgacattttcgatgaccccgaatcgccattttcaaccttcaacttccagtatccaaatcaagcattcaaaaggctacatgatctgatgtacttcaacacactgaacaacattgatgtgataaaggatgccattgttgagagcattgaatacagaagacagaacccatctcgttgctctgtttccctcagtaatgttgaggcaagaaaattcttcaacaaggagttcctaagtaaacccacagcagagtccatttgaattccatgactactggagttcagagcacatgagagatcatcttactatgcacaagagactgactgctactcagagttgtggggacggaggcgtgtgttaggtgaaaacggtgttgattatgcaatacttggcaacagtttctgacagtatgaattttttgacataagcatagggctatatactgtattttaaacattcctcacatttttacctgagcatttttatatatatataaaaatatcctttccttttataaatattaatagtttaactcagtaaaaaaaagcttcccattgtgtgtgaatgttattctgaactagatttgttcatgccatgttacaacactatttttatttaaatgttcatatctacacatgcgaaataaatactttgatatacaaattgccaaaaaaaaaaaaaaaaaaaa

SEQ ID NO: 2529 - DNA, 2458 bp, Rattus norvegicus
  Genbank Accession No. NM_133559
atgcggccctcccagacagcgctgtggctgggtctggttttgtctttggccctcctggctgtggggtgggcctcagcccgaccacccatctatgtcagcagctgggcagtgcgggtgaccaaaggttaccaggaggctgagcgcctggcacgtaaatttggcttcgtcaacctgggacagatctttcctgatgaccagtatttccatctgaggcaccggggtgtggcccagcagtccctgactccgcactggggccaccgtctgcgcctgaagaaagagcccaaggtgcggtggtttgagcagcagactttgaggcggcgggtgaagcgctccctggtggtacccacagacccctggttttccaagcagtggtacatgaacaaggagatagaacaagatctcaacatcctaaaggtttggaaccagggactgactggccggggagtggtggtctccatcttggatgatggcattgagaaggaccatccggacctctgggctaattatgaccccctggccagctatgacttcaatgattacgacccagatccccagcctcgatacacacccaacgatgagaaccggcatggaacacgctgcgctggggaggtgtctgccacagcaaacaacggtttctgtggtgccggtgtggccttcaatgccagaattggaggcgtgcgcatgttggatggagccatcactgacatcgtggaggctcagtccctcagcctgcagccgcaacacatacacatctatagcgccagttggggccccgaggatgatgggcgcacagtggacggacccggcctcctcacgcaggaggccttcaggcgtggtgtaaccaagggccgccaagggctgggcacgctgttcatctgggcctcgggaaacggtggcctccactacgacaactgcaattgtgacggctacaccaacagcatccacacgctgtcagtgggcagtaccacgcggcagggccgagtgccctggtacagcgaggcctgcgcctccacgttcaccaccaccttcagcagcggtgtggtcaccgacccacagatcgtcaccacggacctacaccatcaatgcaccgacaagcacacgggcacctcggcctccgccccgctggccgctggcatgatcgccctggcgctggaggccaacccgctgctgacctggagggacctgcagcacctggtggtccgcgcgtccaggccggcgcagctgcaggcggaggactggaggatcaacggcgtggggcgccaagtgagccaccactatggctatgggctgctggacgcggggctgctggtagacctggctcgcgtgtggctccctactaagcctcagaagaaatgcaccattcgggtggtgcacaccccaacccccatcctgcctcggatgctggtgccaaagaacgtgactgtatgctgcgatggctcgcgccgccgcctcatccgctcgctagagcatgttcaggtccagctgtcgctctcctacagccgccgcggggacctggagatcttcctcaccagccccatgggcacgcgctccacgcttgtggccatcagacccttggatatcagcggccaaggctacaacaactggatcttcatgtctactcactactgggatgaggacccgcagggcctgtggaccctggggctggagaataagggctactattataacacaggaactctgtactactgcacgctgctgctgtatgggacggcagaggacatgacagcgcggccccagaccccccaggtgaccagctgcgcgcacgcatgtgcagagggacacagaggggctgtgccaggaaagtcattgtcccctctccattgtggcagaactctgcctcatctccagcaagcagtggtggtggctctacagccacacacagcagccagtgaccaagggacaggacagctgtcaccctcctaccacacctgctcggcagcttgaccagcgactacactgcctgttccctgcccctcatgctgggagtgcttcagagcccctccaaggcttgtcacctctggcagccatcctggctatcagtcttgggccatggtgctgtccctgctaaccagggcctttggaaggcccctcatcttgaggaaggcccacctctccccaggctggatacccctggggagccagagatgccccactctcaggacagaaggccggtaccccaaggccctgctcccaggccgggataggaatatgccccagaaggccacggcagagagctgcatgggtcacgtgacagcccgcagctcagcctcagctgctcccagtggaagagacgtttcctcattctttttggagcaggtatggcagacaagaggtcagaccacagccaccaaccacctgccccttccctgtctccaaaccatccccatgtctaacctcatagttggcaaataaagttaaacagaaaaaaaaaaaaaaa

SEQ ID NO: 2530 - DNA, 2804 bp, Rattus norvegicus
  Genbank Accession No. NM_133572
ggggggggggttatttttcgaatatataaggaggtggaggtggcagcagcccagctcgcgtcttcccctcccttcctccccacatccctctcctcactcccaggcccactgctcttcctccctccctcccctccctccttccccttaccccaggctcactctcggagcctagccagctgggtcggcgtctgctggcgcggtatcttgtggccctctagctagcctttgcccgccccgccaccatggaggtacccccgcagaagtctgcgccgggctcagctctcagtactgcccgcgtgctgggtggcattcagcggccgcgccacctctcaggctttgggtttgggtctgatggcttgctggggtctccagagcgtgcggcttcctcctctccggttaccactcttacccagaccatgtacaacctcgcagggctcggcagcgagaccccaaaaactcaagtaggaagcctgtcgttccagaacaggctgacagacctgtccctgtccagacgtacctctgagtgctccctgtcatctgagtcctcagaatcttctgatgcaggtctctgcatggactcccctagccctatggacccacagacagcagagcgcacgtttgaacaggccattcaggcagccagtcgggtcattcaaaagatgcaatttaccataaaagcttcggtctttgccagtgaggctgctggacatagtcctgtgctacagaacatcaccaactcccaagcactggacagctgggagaaagatgaagcaggctacagagctgccagtagtcctggggaggacaaagagaacgatggatatatcttcaagatgccacagaagctccctcattccagctctgcccgagctttggcagagtgggccagccgcagagaggcctttacccagaggcccagctcagcccctgacttgatgtgtcttaccactgacgggaagatggacgtggaggaggcgagccctgtggcacagtcttcctccttgactcctgtcgaaagggcttgtgaagaagatgacggatttgtggacatcctagagagtgatttaaaggatgatgatatggtccccgcaggcatggagaacctcattagtgctccactggtcaaaaagctggataaggaagaggaacaggatctcatcatgttcagcaagtgccagcggcttttccgctctccatccatgccgtgcagtgtgatccggcccatcctcaagaggctagagcggccccacgacagggacgtgcctgtcctgagcaagcgcaggaagagtgggacacccctggaagagcagcagcttgaagaacccaaggcccgggtcttccgctcaaagtccctgtgtcacgagattgagagcatcctggacagtgaccaccgtggcctgattggagattactctaaggccttcctcctgcagactgtggatggcaaacaccaagacctcaagtacatctcaccagaaactatggtggccctgttgacaggcaagttcagcaacatcgtggagaagtttgtaattgtggactgcagatacccctatgagtatgaaggcgggcatatcaagaatgctgtgaacttgcccctggaaccggatgccgagacctttctgctgaagcatcccatcacgccttgtaacctggacaagagaatcatcctcattttccactgtgaattctcatctgagcgtggaccacggatgtgccgcttcatcagggaacgggaccgtgcagctaacgactatcccagcctgtactaccctgagatgtacatcctcaaaggcggctacaaggagttcttcccgcagcatccgaacttttgtgagccccaggactaccgacccatgaaccatgcagctttccgggatgagctgaggaacttccgcctcaagacacgcagctgggctggggaacggagtaccacccaactctgtagcaggctgcaagaccagtgacgagccagcctcagtcctgccaccatccttacctcaggaggcttgcgagccagtgggtcccatgggcctatgcggccacctacttgctagaggcctcaggtgctatagggggttggggggatggtgtggtgtcacatctgtctgtccctgtcctcaattttcctgtctcactccactaattttctgtatcttggatctgatcccatcttaaagagctgaaccaatgggtgaataccagctaagaggaagtcctttgtgttcaatgagagcccttttacaatctcctttttccttgtttgtgttgactccttgtcttaccccttcgcagggagagcctcagccctttaagatgagcacagtagcttcttgggtagcctggattgcaggacgctacactgctgcacagggctgtgtctgctctcctctcctggcctctgcacagattcctccattggaagcataagtgcttagtttcctgttgtcgtcttacccatagctttcattttcgtctgtctcacttagcgtgtcccaggacacactgacagctggggaggctcccttgtacagctggggactagagattcaaatatcatgtactcattaggcttggcttttgttagcccacaaagggatcttttcctttaagacccccagagctagagcaaaggcctgattcaggagcctctgggagccccatcctcactgctgtgaaccctagagcctcactggtcagcacttgttgctgggcaatgaaccagtcactgagcttcactttttggtccttctctgtccctccctgtccctctctgtccttctttccatatctggtcctgagta

SEQ ID NO: 2531 - DNA, 1619 bp, Rattus norvegicus
  Genbank Accession No. NM_133585
ggttcgagagtcggttgaacaacaggctgatagttttaaagcgactcgcttcaacctggagacagagtggaagaacaactacccccgcctgcgggagctcgacaggaatgaactatttgaaaaggctaaaaatgagatcctcgatgaagtcatcagtctgagccaggttactccaaagcactgggaggagatccttcagcagtccctgtgggaacgagtgtcaacgcatgtgatcgagaacatctacctcccagctgcccagaccatgaactcaggaacattcaacaccacagtggacatcaagcttaaacagtggactgacaagcagcttcctaataaagcagtcgaggttgcttgggagaccctacaagacgaattttcccgcttcatgacagaacccaaaggaaaggaacacgatgacatatttgacaaacttaaggaggctgtgaaggaggagagtatcaagcggcacaaatggaacgacttcgcagaagacagcttgagggtcatccagcacaacgctctggaggaccggtccatatcagataagcaacagtgggacgcagccatctacttcatggaagaggcacttcaaggtcgtctcaaggatactgaaaatgctattgaaaacatgatcgggccagactggaaaaagaggtggatatactggaagaatcggacccaagagcagtgtgttcacaatgaaaccaagaatgaattggaaaagatgctgaaggttaatgatgaacacccagcttatcttgcaagtgatgagattaccacagtccggaagaacctggaatctcgaggagtcgaagtcgatccaagcctgattaaggatacttggcatcaagtctatagaagacatttcctaaaaacagctctaaatcactgtaacctttgtcggagaggtttttattactaccagaggcattttatagactctgagctggagtgcaacgacgtggtcctgttctggcgaatacagcgcatgctcgctatcactgccaacacgctgaggcagcagctgacaaacaccgaagttaggcggctagagaaaaacgttaaagaggtattagaagattttgctgaagacggcgagaagaaggttaaattgcttactggcaaacgagttcagctggcagaagatctcaagaaagttagagaaattcaagaaaaacttgatgctttcattgaagctcttcaccaggagaagtagacggtgtcaaaatcctgctcatgttaacacctctgcatacatttgaagaacgaaaacttcagagtcttgtcctgcctccttttctccagttctacccttttcagtgcaaaataaagtcatagggtaaaagtaatgtatgtgtggtacaggcacttaacccgcagctgccgtgtgagcagaagaacactggaaatggcaactaccttctgtgtgcttgtgctgacaggaaacactgggaaaacatagttggccttgaggcttagtcctcaaagataaggaggtggctctctcgggccttatctgtggtggcactaatgcgactcgttatgggtgttatcagacatttagtggtagttgctttggaataaaatggtactattttaaaaaaaaaaaaaaaaaa

SEQ ID NO: 2532 - DNA, 2146 bp, Rattus norvegicus
  Genbank Accession No. NM_133593
cggacccggcaccgaatcactgactcgcccaggtgtcgggaaaatgatccacagtctatttctcatcaactgttctggcgacatatttctagaaaaacactggaagagcgttgtaagccaatctgtgtgtgactatttctttgaagctcaggagaaagctgctgatgttgaaaatgtaccaactgtcatttcaacacctcaccactacctcattagtatctaccgggataagctcttctttgtgtctgtgatacagactgaagtgccacctctctttgtaattgagtttctgcatcgagttgctgacacttttcaggactactttggtgagtgttcagaggctgcaattaaggataatgtggtcatagtgtatgagctcttggaagaaatgttagacaatggattcccactggctaccgaatctaacattctgaaagaactgattaaaccaccaacaattctacgttctgtcgtcaattctattacaggcagtagtaatgttggggacacgctccccactgggcagctgtccaacatcccatggcgtcgagcaggtgtaaagtacaccaacaatgaagcctactttgatgtagtcgaagagatagatgcgattatagataaatcaggatctacagtctttgcagaaattcaaggtgtcattgatgcttgcattaagctgtctggaatgcctgatctctctctctctttcatgaacccaaggcttctagatgatgtcagcttccacccatgcatccggttcaaacgctgggaatctgagagagttttgtcattcattcctcccgatggaaatttccgactcatatcataccgcgtcagctcacaaaatctagtggcaatcccagtgtatgtgaaacataatatcagctttaaggaaaacagctcttgtggtagatttgatataacaattggaccaaaacagaatatgggaaaaacgattgaaggaatcacagtgactgttcacatgccaaaagttgtgctgaatatgaacctgacaccaacacaaggcagctatacattcgatccagtcaccaaggtactagcatgggatgtggggaaaattactccacaaaagctcccaagtcttaaaggactggtaaatttacagtcaggagcacccaagccagaagagaacccaaacctcaacatacagttcaagatccagcagcttgctatttcaggcttaaaagtgaaccgcttggacatgtatggtgagaagtataagccatttaaaggagtcaagtatatcacaaaggccggaaagttccaagtgaggacatgagaagaggccagacttgctcaagatcagtttgttttgcaagtgtcattgcggtttcttactattaggtaccaagtgggtgggaataatatagagcatctgggtcaagctaccctgctaacaaagttgcttagtaatgatgtaggctcctcaggagctttaagctaaggaaagttttctaaagacttagcttattttgtatcttttcacttaggaaaaggtttaggtgatttttttccatgggggccaccagctgaatgctgcccatgggtaacagtcaaggcagaaggctacagtgataacctctctcctaaagcaagtgaactggtctcatcttccagcaggaactgtctcagtctatgaggtgtcagctgtagccaagggtcacaccttctgatcttagccatctcaatcagtgtctgtcccaagagaggagattgcccccacccccaagaagtttacagaaaactgcctcttcaagtgtttgccttactcagcttttcacttgtgccattaagcaagcactgtagcaaaagccacttccacatggcccaggcagggagccctgcagctccatgctccattcctcacctggttaaccttgggtattatattttttataaataagatttttatgtaaagctcagattttgatttacaagaccttgctgcagtaaatattccatcaatcttgagccaccagttcagctgttagatagcacagtcaaatcatttgcatcaaaagggcaaatactttattaagataatgaaagggaacactacttctgctgttaggcacaagtgtctgtgcttttaaacaaattcaagtagtaaaagagaaaatcaagc

SEQ ID NO: 2533 - DNA, 1928 bp, Rattus norvegicus
  Genbank Accession No. NM_133618
cagtccagactctaagatttcagaatgactaccatcttgacttccacttttagaaacctttctactacatcaaaatgggccctcagattttctgtaagacctctgagctgttcttcacaagtacagtctgccccagctgtccagaccaagtcaaagaagactttagcaaaacctaatctaaagaacattgtggtggtggaaggtgtccgaattccatttctgctgtcaggcacttcgtataaagacctaatgccacatgatttggctagagccgcactttcgggtttgttgtatcggaccaatattccaaaggatgttgttgattatatcatttttggtacagttattcaggaagtaaaaacaagcaatgtggctagagaggctgccctgggagctggcttctctgataagactccagctcacactgtcaccatggcttgtatctcttcaaaccaagccatgaccacagctgttggtctgatagcttctggccagtgtgatgtcgtcgtggctggtggtgttgagttaatgtctgacgtccctattcgtcattcaagaaatatgaggaaaatgatgcttgatctcaataaagccaagactctggcccagcgcctgtccttactcactaaattcagattgaattttctgtcccctgagctccctgcagtggctgagttctccactaacgagacaatgggccactctgccgaccgtctggctgctgcctttgctgtttctcgaatggaacaggataaatatgcactgcgttctcacagtctggccaagaaggcacaggatgaaggacatctttctgatattgtacccttcaaagtaccaggaaaagacacagttagcaaagataacgggatccgtccttcctcactggagcaaatggccaaactaaagcctgcattcatcaaaccctatggcacagtgacagcagcgaattcttctttcctgactgatggcgcttctgcgatgctaatcatgtcagaggacagagctctggccatgggttataagccaaaggcatatttgagggattttatatatgtgtctcaggatccaaaagatcagcttttacttggaccaacatatgctactccaaaagttctagaaaaggcaggattaaccatgaatgatattgacgcttttgaatttcatgaagccttctcaggtcagattttggctaactttaaagctatggattctgattggtttgcacaaaactacatgggtaggaaaaccaaggttggagcacctcctctggagaagtttaatatctggggcggatcactctctctgggacacccttttggagccactggctgtcggttggtcatggcagctgccaacagactgaggaaggatggaggccagtatgctttagtggctgcctgtgcagctggaggacagggtcatgctatgattgtggaagcctacccaaaatgactgctctggaaggaggcaactgatctctgcagcactcgcactgggcaatgccatttcaatgcactaccaagtgatacctgcagttcctagctcttcttaggaaacaacatttgtggccttctcttaaatattttgcggtcaagccttgccagtgttcgagctttccgataatcacagcttctgctctctaagttccagactatcacagatgtgtacacagttcttgttatctcttgtctctaagactaatgactgccagctgcttggagagaggttagctgaggtttagaaccatctttgtaacatttgcagaatctcctccttcctgtcagtgtcctacagagaattattttttctaaaatacaatccaatgtgcctacattaagttactatagaaaaaaataatctaaacatctcctaaaactgacttgcttagagacatgtttgttgaccttaataaagtagacatgtattag

SEQ ID NO: 2534 - DNA, 2396 bp, Rattus norvegicus
  Genbank Accession No. NM_133624
ttaaaagatctaactcttcacaagttctctggagacaatttggaacttcctaggttatgacagggtctttgccacagagcccgtgaaaaaggacagagtgatcagcagcctgaccctgaacctgtcaggcattcttctctaaagaatttcgtttaagagacaaaagagcaccatggacatggcctcggagatccacatgttacaacccatgtgcctcattgagaacactgaggctcacctagtgatcaaccaggaggctctgaggattttgtctgccatcaaccagcctgtggtggtggtggcaatcgtgggcctctaccgcacaggcaaatcctacctgatgaacaaattggctgggaagagaacaggcttctccctgggctccactgtgcagtctcacaccaagggcatctggatgtggtgtgtgcctcaccccaagaaggcagggcaaaccctagttctgcttgacaccgagggccttgaagatgttgagaagggagacaaccagaacgactgctggatctttgccttggcagtcctcctcagcagcaccttcgtctacaacagcatgggaaccatcaaccagcaggccatggaccagctgcattatgtgacagagctgactgatcttatcaagtcaaagtcatcacctgatcagagtgggatagacgactctgctaactttgtgggcttctttccaacctttgtgtgggctctgagagatttctccctggagttggaagtcaatggaaaacttgtcactcctgatgagtacctggagcattcgctgaccctgaagaaaggagctgataagaaaactaaaagctttaatgagcctcgactgtgcatcaggaaattctttccgaagaggaagtgtttcatctttgacagacctgctctgaggaagcaactctgcaaactggagactctgggggaggaggagctgtgtagtgagtttgtagaacaagttgcagaattcacctcgtatatcttcagttactctgctgtcaaaactctgtctggtggcatcatagtcaatgggccacgtctaaagagcctggtgcagacctatgttggtgccatcagcagtgggtctctcccctgcatggagagtgcagtcctgactttggcccagatagagaactcagctgcagtacaaaaggccatcacccactatgaagaacagatgaatcagaaaatccagatgcccacagaaaccctccaggagctgctagacctgcacaggctgattgagagggaggccattgagatcttcctaaagaattctttcaaggatgtagaccagaagttccagacagaattagggaacctgctgatatcaaagcgagatgcctttattaagaagaactcggatgtatcatcagctcattgttcagatctgatagaggatatttttggacctctggaagaagaagtaaaacaagggacattttccaaaccaggaggttacttcctcttccttcagatgagacaagagctagagaagaagtataaccaggctcctgggaaggggctcgaggcagaagcggtgctgaaaaagtactttgagtccaaggaagacattgttgaaacacttctaaagacggatcagtcactcacggaggcagcaaaggagattgaagtggaacggattaaggctgaaactgctgaagctgcaaacagagagttagcagagaagcaggagaagtttgagctgatgatgcagcagaaggaagagagttaccaggagcacgtgagacagctgactgagaagatgaaggaggaacagaaaaagttaatagaagaacaggacaacatcatagctcttaaacttcgggaacaggaaaaatttctcagggaaggatacgagaacgagagcaagaaacttcttcgagagattgagaacatgaagagacgacaatcacctgggaaatgcaccatactctaaaggtccgaggcccaaacctctctgccaaactcttcatcacagaatatgtggactgacacctttaggctttgaaacagctgttatgatactacgttcattttagctcaaaaatcaatcacatgcaaatccagtttggggtcaccgtctgaccactgggcagcatcagaagaagttcgcccagccacatatgttcctcctctataatcttaagttttcctctttcctacagtacaacttctgcaattacagagcaggcaacttttaattaacttacaaaacaaactccctttctctgaggaccttgacattttgctacagtccttcaaaacctaaatcccatctccattttccctgtgatctttctccctactatggcagtgtgtcttgaactttctcaggacaaatgtcttgcaagagcacgagttaataaaattgattagcctaccat

SEQ ID NO: 2535 - DNA, 1934 bp, Rattus norvegicus
  Genbank Accession No. NM_134334
cctataagccggcgacctctggcattaagctttgctctcttcgggccgtcgcgaccatgcagacccccggcgtcttgctgctcattctcggcctcctggatgcgtcctcctccgcgcttatcagaatccccctgcgcaagttcacatccatccgtcggactatgacggaagtgggaggctctgtggaagacctgatccttaaaggtcccataaccaagtactccatgcagtcatctcctaggaccaaggagccagtgtcagagttactaaaaaactacctggatgcccagtactatggtgagatcggcattgggactcccccacagtgtttcacagtcgtctttgacactggctcctctaacctgtgggtcccctccattcattgcaagctgctggacatagcctgctgggtccaccacaagtacaacagtgacaagtccagcacctatgtgaagaatggcacatccttcgacatccactacggctcaggtagcctctctgggtacctgagccaggacactgtgtcggttccatgtaagtcagacttaggaggtatcaaggtggagaaacagatctttggggaagccaccaagcagcctggagtcgtattcatcgcagccaagtttgatggcatcttgggcatgggctacccttttatctctgttaacaaggtgctcccggtcttcgacaacctgatgaaacagaagctggtggaaaagaacatcttctccttctacctgaacagggacccaaccgggcaacctggaggagaactaatgcttggcggcactgactccagatactaccacggggagctgtcctacctgaacgtcacccgaaaggcctactggcaggtgcacatggaccagctggaggtgggcagcgagctgaccctgtgcaagggaggctgtgaggctattgtggacacagggacgtctcttctggtggggcctgtggacgaggtgaaggaactacagaaggccattggggcagtgcctctcatccagggcgagtatatgatcccttgtgagaaggtgtccagcctgcccattatcacctttaagctaggaggccaaaactatgaactacacccagagaagtacatactcaaggtatcgcaggctggaaagacgatctgcctgagtggcttcatggggatggacataccccctcccagtgggccgctctggatcctgggcgatgtctttattggctgctactacaccgtgtttgacagagaatacaatagggtcggctttgccaaggctgccacactctaacttgctccttcttcactgtcagggaactggatcagagtccagtagagaaagccagccagccccatccctccacctgccccactcacacatattcacactcgcctagtgttgctgggcccttgggaggcctggctggagctggtccagctgttctgttctgtggtccctgtccctgggttcagattgctgccctccgcctgtctgaaggaggccaaggcctacccagtacaaaaggctgcctttaaaggcccctactggcttggtagctgccgggatgaattgtcttgtcctgctgccctttgctgcgtgggcagcactctgaagcaggcaaatgggtcttgggatccctcccagaaacctgctctgaccagaccctcaggcagcctggggatggcaccaagctctactgccccactatctctggcctggcaaaggctgaaggtgagcagaaggagcaagaggacagaagcaaaactatatgaacctggggggggttacctgggacctgaccccaccctcctgggaaggcatgcttcagcctggggcagaggtaggatggctgactggttttggctggcctctgctgccctcatcctgggctagtcagatgggagccaaagttgatatacaaataaagttgttttgggcctcttt

SEQ ID NO: 2536 - DNA, 1874 bp, Rattus norvegicus
  Genbank Accession No. NM_134346
gccggccgccccgaagactgccggcgacggcgacggggtactgacagcgcgagaggtactaagtgtaacaagtgtgcatcatgcgtgaatataagctagtcgttcttggctcaggaggtgttgggaagtcggctctgactgtacagtttgttcaaggaatttttgttgaaaaatatgatcctacgatagaagattcttatagaaagcaagttgaagtagatgcacagcagtgtatgcttgaaatcctggatgctgcaggaacggagcagtttacagccatgagagatctgtacatgaagaacgaacaaggctttgcgttggtttactccatcacaacgcaaatcgactgtaatgacttacaaggtctgagagagcagattcttcgggttaaagacactgacgatgtcccaatgattctggttggtaacaaatgcgacctggaagacgaaagagttgtccccaaggaacaaggtcagaacctggcaagacagtggagcaactgcgctttcttagagtcctccgccaagtccaagataaatgttaacgagatcttttatgacctagtgcggcaaattaacagaaaaaccccagtgcctgggaaccgtcgcaaaaagtcaccatgtcagctgctttaatgtactgaatgcattgtagctctgagccaggtctgaagaactgttgcccaattcagcagtgccagcattccaactttgttaaacctaccaacatcttaaatggactttcccgtggtggtaccctgtaagaggcggacgaaagctactctatcagtttgcacattctaatcactttccagtatcacgagaggtttgacttatatgatagttctagagtatcgagctggtaaaaccagaggctacatccagtattactgctaagagacattcttcatccaccaatgttgtacatgtatgaaaatggtgtactgtatactttaacacacccatactttgtattggagagtacaataatgtaaatcctaaaagcaccactattttagcataataaaagaaagtccaaagagctcctatatagactactccagataactttgcttctttgatacttgtagcttactgtaattttttttaaattcaaggtcattatcattgtattatacaaaataagcgctttgattaacacagctatatagtttttttaatttttcaaaaacctgtggagacagtgatcttgtctttaaaatatgatagtcctttcagtataatgtcttagattaaagacgttgcctttaatatctgttgggaaggaaatgtccagactttcaaatctccttattattatgtttccttttatcgtttacatagggaacaatgtttatagttgtgtgtacagtgggggtctacaacaagaagtgtatattttcaaacagttttttaatgatttaacaactttgtaaatcattttcaggcttctgcagctgtagattctcactgtgcctcccttgcttgctcgtgcacacgtgtgtctgcaataccaaatacacaggtttagtatcttcgcctgttagtgactgtttccatgtgtaacgttttggttgagatgttaaatggtgacgagtactgtgatgtgaatgtggttgtaatttaatcatgtgtaattggtcacaaggctaatctgcagtaactcttgctgttctatttaacaatgccttgttgccgtttgtatcgattaacgtttgggtgtaaacattgtgtgtccatccaacagggagccacagtatttaaattgaccaacctgatgttgaggtggccaaatgtaaactaaaagccttaattaaagaggagcaattttgtataacttagcatccgtgttcaataaatttggattgccgtgca

SEQ ID NO: 2537 - DNA, 2443 bp, Rattus norvegicus
  Genbank Accession No. NM_134350
gatggttcttagcacagaggaaaacaggagtgttgatttagtcaacttacccagtgtcccactgcccgatggagaggctggcgtaggggagaacaacaaggattccgtgaacaacctctgcagtcagtatgaggagaaggtgcggccctgcattgacctcatcgactccctgcgagctctgggtgtggagcaagacctggccctgcctgccatcgctgtcatcggggaccagagttcagggaagagctctgtgctggaagcactgtctggagtggccctccccagaggcagtggtattgtcaccagatgtcccctggtgctgaaattgaagaagctgaatcagggagaggagtggaaaggcaaagtcacctatgatgacatcgaagtggagctctctgatccttcagaggtggaagaggccatcaacacaggtcagaaccatattgctggggtagggctggggatcagtgataaactcattagcctggatgtcagctccccacacgtcccagacctgactctgattgaccttcctggaatcaccagggtggctgtaggcaaccagccttcagacataggacggcagatcaagagacttatcactaactacatccaaaaacaagagaccatcaacctggtggtggtccccagcaatgtggacattgccaccacagaggccctgagcatggctcaggaggtggaccctgatggggataggaccatcgggatcttgaccaagcctgatctggtggacagagggactgaagacaaggtcgtggatgtggtgaggaacctcgtgtgccacctgaagaagggctacatgatagtcaagtgcaggggtcagcaggacatccaggagcagctgagcctggctgaggctcttcagaaggagcaagtcttcttcaaggaacaccctcaattcagagctcttctggaggatgggaaggccacagtgccctgcctggcagagaggctgaccatggagctcatctcacacatctgtaaatctcttcctttgttagaaaatcaaataaaggaaagtcaccagagtacaagtgaggagctgcagaagtatggtgcagacataccagaagatgagaatgaaaaaactctcttcctgattgaaaaaatcaatgcttttaaccaggacatcactgccatagtagaaggggaagagattgtgagggagaaagaatgtcgcctattcaccaagctccgtaaagagttcttcttgtggagtgaggagatcgaaaggaatttccaaaaaggttctgatgctttatataaagaagtctacacattcgaaatgcagtatcgtggccgagaactaccagggtttgtgaattacaaaacatttgagaacatcataagaagacaaatcaaaaccctggaagaaccagctatggaaatgcttcacaaggtcactgaaattgtacgggctgcctttacaacggtttctgagaaaaatttctctgagttttttaatctccacagaactaccaagtccaaacttgaagacatcagattagaacaggaaacggaagcagagaaggcgatccggcttcacttccagatggaacaaatcatctactgccaggaccaaatttataggaaagccttgcagaaggtgagagaggaggaagctgaggaggaggagaggaagcatggcaaaagcaggtccgctcagtccccaaatttacagacctcatccatggatgaaatcttccagcatctgaatgcctaccgccaggaggctcacaactgcatctccagccacattccattgatcatccagtatttcatcttgaagatgtttgctgagaagctgcagaagggcatgctccagctcctgcaggacaaggattcctgcagctggctcctgaaggaaaagagtgacaccagtgagaagaggagattcctgaaggagcggttggcaaggctggcccaagctcagcgcaggctagccaaattccctggttaagctggccctgtcctttcctgtgtctcctggataattaaatattcagggacagaagggttccagccttgttgtggtttgccctaagatatctgtattttgatgctaattccactgccccagggacagctgcctagtcctgtactcaggaatcaggtgacttcaccagaaacttctccccattgaatttgtaaaatacaggtgaggggcacatagaggatagaaagaggcctgtaattggaccagaagtaaggattggtgggagagaagtttaaaggaaggggaggatactggaagggaaagaaggagaggagagagatagagagaagccatggcaggacaatatggcaggtgacattaagattccatgctgtacctttacaggttgttacaaatgttcttaagggatggatggtactgggctttgtatgtttaggtgggcaattatatcttaccaattgggtc

SEQ ID NO: 2538 - DNA, 1337 bp, Rattus norvegicus
  Genbank Accession No. NM_134351
gcatctgcgccctccgcagtcctctgcctcgttgccgctccgtctccccagagtcgccttctctcatcgctgcagccatgaacgggcagctcaacggcttccatgaggcgttcatcgaggaggggacattccttttcacttcagagtctgtaggggaaggtcatccagataagatttgtgaccaaatcaatgatgctgtccttgatgcacaccttcagcaggaccctgatgctaaagtggcttgtgaaactgttgctaaaactggaatgatccttcttgctggggaaattacatctagagctgccattgattaccagaaagtggttcgtgaagccataaagcacattggctatgatgattcttccaaagggtttgactacaagacttgtaatgtgttggttgccttggaacaacagtcaccagatatcgcccaaggtgttcatcttgaccggaatgaggaagacattggtgcaggagatcagggtttgatgtttggttatgccactgatgaaactgaagagtgtatgcctttaactattgtcttagcacacaagctaaatgctaaactggctgagctacgccgcaatggcacattgccttggttacgcccagattctaaaactcaagtgactgtgcagtatatgcaagatcgaggtgctgtgattcccatcagagtccatacaattgttatatctgttcagcatgatgaagaagtttgtcttgatgaaatgagggatgctctgaaggagaaattgatcaaagctgttgtacctgcaaagtaccttgatgaggatacaatttaccacctacagccaagtggcagattcgttattggtgggcctcagggtgatgctggtttgactggccgaaaaatcattgtggatacttatggcggttggggagctcatggaggaggggccttttcaggaaaggattataccaaagtggaccgttcagctgcttatgctgctcgttgggtggcaaaatcccttgttaaaggaggtctgtgcaggagggttcttgttcaggtctcttatgctattggagtttctcatccattgtcgatctccattttccattatggtacttctcagaagagtgagagagagctattagaaattgtgaagaataattttgatcttcgccctggggtcattgtcagggatctggatctgaagaagccaatttatcagaggactgcagcctatggccactttggtagggacagcttcccctgggaagtgcccaaaaagcttaaatattgaaagtgttagccttttttccccagacttgttggcgtaggttacagagaagccttcaagctctgagggaaaggg

SEQ ID NO: 2539 - DNA, 1277 bp, Rattus norvegicus
  Genbank Accession No. NM_134352
tgcggccgcgaagaacccatgggcctcctgaggcggcggctgctgctgctggtggtggtggtgacgacctgtgtcccagcctcccagggcctgcggtgcatacagtgcgaaagtaaccaggactgcctggtggaggagtgtgccctgggccaggacctctgcagaaccacggtgcttcgggaatgggaagacgccgaggagctggaggtggtgaccagaggcctgtgccacaaggagaagaccaacaggaccatgagctaccgcatgggctcggtgatcgtcagcctcaccgagaccgtgtgtgccacaaacctctgcaacaggcccagacccggagcccgagggcgaccttttccccggggccgttaccttgagtgtgcatcctgcacctctctggaccagagctgtgagaggggccgggagcaaagcctgcagtgccggtatcctacagaacactgtattgaagtggtgacgctccaaagcacagaacggagcgtgaaggacgaaccctacaccaaaggctgtggcagtcttcccggatgcccgggcacagcaggtttccatagcaaccagacctttcacttcctgaagtgctgcaacttcacccaatgcaatggtggcccagttctggatcttcagagcttaccaccgaatggcttccaatgttacagctgtgaggggaacgagcacctttggatgttcctacgaagagacgtcctcattgactgccggggaccaatgaatcagtgcttggaggctacaggcttagatgtgctgggaaaccggagttacaccgtaagaggctgcgccacggcttcctggtgccaaggttcccacgtggccgactccttccagacccacgtcaacctctctatctcctgctgtaatggcagtggctgtaaccgccctacagggggcgcccccgggccaggccctgctcatcttatcctcattgcctccctgctcctgaccctcagactgtggggcatccctctctggacctgaatcctgagccgtctgccctggctggacccaggaacttttgactcctccgcctctgctccatctttgaggacaggcgtgctgtattgtcttcttgggcctcaagaactggaagagaattgagaaaagggctgcgggccagcaggggggcctcttggttgagttaatattgttgctgttattattattatcattgttattaccctaatttattatgtaaatatatatataagatttttgtaccagtaaaaaaaaaagcggccgcagaattcgat

SEQ ID NO: 2540 - DNA, 2190 bp, Rattus norvegicus
  Genbank Accession No. NM_134353
ctgccgcccggacccagcaccgccagcctcgctcccccggttccacggccgttgagtacgcgtcgattccggttgaattttgtccctctgcgctcgcccccgctcccctccccccggctccgtcccccggccccgcactcgctctcctcctctcacgggaaaggtcgcggcctgcggccccgcgggcagccgtgccgagatgaaccccagcgcccccagctaccccatggcctctctgtacgtgggggacctgcaccccgacgtgaccgaggcgatgctctacgagaagttcagcccggccgggcccatcctctccatccgggtctgcagggacatgatcacccgccgctccttgggctacgcgtacgtgaacttccagcagccggcggacgcggaacgtgctttggacaccatgaattttgatgttataaagggcaagccagtacgcatcatgtggtctcagcgtgatccatcacttcgtaaaagtggagtaggcaacatattcattaaaaatttggacaaatccattgacaataaagcactgtatgatacgttttctgcgtttggtaacatcctttcatgtaaggtggtttgtgatgaaaatggctccaagggctatggatttgtacattttgaaacacaggaagcagctgaaagagctattgaaaaaatgaatggaatgcttctaaatgatcgtaaagtgtttgttggtcgatttaaatctcggaaggaacgagaagcagaacttggagcaagggcaaaggagttcaccaatgtttacatcaagaactttggagaagacatggatgatgagcgtcttaaggaactctttggcaagtttgggcctgccttaagtgtgaaagtaatgacagatgaaagtggaaaatccaaaggatttggatttgtaagctttgaaaggcatgaagatgcgcagaaagctgtggatgagatgaatgggaaggagctcaatggaaaacagatttatgttggtcgagctcagaaaaaagtggaacggcagacggaacttaagcgcaaatttgagcagatgaagcaagacaggatcaccagatatcagggtgttaacctttatgtgaaaaatcttgatgacggaattgatgatgagcgtctccggaaagagttttctccatttggtacaatcactagtgcaaaagtaatgatggagggtgggcgcagcaaaggatttggttttgtatgtttctcctcccctgaagaagccactaaagcagttacggagatgaatggtagaattgtggccaccaagccactctatgtagctttagctcagcgcaaagaagagcgccaggctcacctcactaaccagtatatgcagaggatggcaagtgtacgagctgtgcccaatcctgtgatcaacccctaccagccagcacctccttcaggttacttcatggcagctatcccacagactcagaaccgtgctgcatactatcctcctagccaaattgctcaactaagaccaagtcctcgctggactgctcagggtgccagacctcatccattccagaatatgcccggtgctatccgcccagctgctcctagaccaccatttagtacgatgagaccagcttcctcacaggttccacgagtcatgtcaacacagcgtgttgctaacacatcaacacagacaatgggtccacgtcctgcagctgctgctactgcagccactcctgctgtccgcactgttccccagtataaatacgctgcgggagtccgcaatccccagcaacatcttaatgcacagccacaagttaccatgcaacagcctgcggttcatgtgcaaggtcaagaacctttaactgcttccatgttggcatctgcacccccgcaagagcaaaagcaaatgttgggtgaacggctgtttcctcttattcaagccatgcacccttctcttgctggcaaaattactggcatgctgttggagattgataactcagaattgcttcacatgcttgagtctccagagtctctccgctcaaaggtcgatgaagctgtagctgtactacaagcccaccaagcgaaagaggctgcccagaaagcagtgaacagtgccactggtgttccaactgtctaaattgatcagggaccacgaacagaaactcgtgcttcaccgaagaaaaatatcttaaacatcgaaaaatttaaatattatga

SEQ ID NO: 2541 - DNA, 879 bp, Rattus norvegicus
  Genbank Accession No. NM_134387
  misc_feature (1)..(879): n = a or c or g or t
cagactggggcaccatggacctggggcttgcaggtcggcgggcgctggtcaccggcgcgggcaaaggcatcgggcgcagcactgtgctggctttgcaggcggctggtgcacaggttgtggcggtgagtcggacgcgagaggacctggacagcctggtccgggagtgtcctggtgtggagcctgtgtgtgtggacctggccgactgggaggccacagaacaggccctaagcaatgtgggaccggtggaccttctggtgaacaatgctgctgtggctacgttgcagcccttcctggaggtcaccaaggaggcctgtgacacgtccttcaacgtgaattttcgggctgtcgtccaggtgtcgcagattgtggcnaggggcatgatagctcggggagttccaggggccattgtgaatgtctccagccaggcctcccagcgtgcactgaccaaccataccgtctactgttccaccaagggtgctttagacatgttgaccaaggtgatggccctagagcttgggccccacaagatccgtgtgaatgcagtaaaccccacagtagtgatgacacccatgggccgggccaactggagtgacccgcacaaagctaaggtcatgctggatcgtatcccacttggcaagtttgctgaggtggagaacgtggtagacaccatcctcttcctgctgagcaaccgaagtagcatgactactggttccgctttgccagtggatgggggcttcctggctacctaagccctccctaccaatactctgctcaactcatgttcagaacatcgtgccctccatccctccaataaagctctctgcccagcctgtgtgctgattctccacccaaaaaaaaaaaaaaaaaaaaaaaaaaaaa

SEQ ID NO: 2542 - DNA, 3765 bp, Rattus norvegicus
  Genbank Accession No. NM_134397
cctgacactaggagcacggggccgcaggactcggagtccttcgcccacactcggggagtctctggcacctcgcaagggcagcttcagtggcaggctaagcccagcctacagtctgggctctcttactggggcttcacctcgccagagcccccatgctcaaaggaagctttccagtggggacttgcgggtgcccatcccaagggagaggaaaaatagcatcacggagatcagcgacaatgaggacgatctcctggagtaccacaggcggcagcgccaagagcggctccgggagcaggagatggagaaggctggaacgccagcgcctggagaccatcctgaacctgtgtgctgagtacagccgagctgacgggggacctgagactggggaactgcccagtataggagaggccacggcagcactggctttggcaggcaggaggccctcaagaggcttggcaggagccatagtagtgtctggaaggagtggcgaggagtctggaggtgcctcgcagcgcctgtgggagagcatggagcgctctgatgaagagaatctcaaagaggagtgcagcagcacagagagcacccagcaggagcacgaagatgctcctagcacgaagctccaaggagaggtgctggctgtggaagaggagcgggctcaggttctggggcgcgtagagcagctgaaggtccgagtgaaggagctggaacagcagctgcaggaggcagcccgagaggctgaaatggagagagcactgctgcagggggagagggaggcggagcgagcattgctgcagaaggaacaaagagctatggaccagctgcaggagaagttggtggccttggagacaggcatccagaaggagagggacaaggaggcagacgctctagagactgagacaaagctctttgaggacctggagttccagcagctggagcgggagagtcgcgtggaggaggagcgggagttggccggccaagggctgcttcgcagcaaggctgagttgctgcgcagcgtgagcaagagaaaggagcgcctagctgtactggacagtcaggctgggcagatccgggcccaagcagtacaggagtcagagcgtctggcccgggaaaagaatgctgtcctgcagctactgcaaaaggagaaggagaagctgactgtgcttgagaggagatatcattcgctcacgggtggcaggccttttccgaagaccacctcaaccctcaaagaggtttaccgctccaagatgaatggtgacatggccagccccctgcccaggacccgtagtggccctctcccctcctcctcaggctcctcatcctcttcttcacagctcagcgtggctaccctgggccgtagtccttccccaaagagtgccctgctcgcccagaatggcaccagtagtctccctcgaaacctggcagccacgctgcaggacattgagaccaagcgccagctggccctacagcaaaaggtcgagttacctcctgccgagcccctctcacccgaagacccagcagggcaccaagtgatcgaggagcaacggcgacggctggctgagctgaagcagaaagcagcggcagaggctcagtgccagtgggatgccttgcatggtgcagccgcctttccagcaggcccgtctggcttccccacgctcatgcaccattctatcctgcaccacctgccagcaggcagggaacgtggagaggagggcgagcacgcttacgacaccctgagcctggagagttcggacagcatggagaccagcatctctacggggggcaactccgcctgttcccctgacaacatgtccagcgctagtggtctggacatgggcaagatagaggaaatggagaagatgctaaaggaagctcacgcggagaagagccggctcatggagtccagggagcgggagatggagctacggaggcaggccctggaggaggaacgtcggaggcgggagcaagtggagcggaggctgcagagtgagagcgcccgcaggcagcagctggtggagaaagaagtcaagctgagggagaagcagttttcccaggctcgacctctgacacgttatcttcccaaccggaaggaggactttgatttgaagacccacatagagtcgtcaggccatggggtggacacctgcctacatgtggtgcttagcagcaaggtctgccgtggctacttaatcaagatgggtggcaagattaaatcgtggaagaagcgctggtttgtctttgaccggctgaagcgcaccctttcctactatgtggacaaacacgagacgaagctgaagggggtcatctacttccaggccatcgaggaagtgtactatgaccacctgcgcagcgcagccaagagtccgaatccagccctcaccttctgtgtgaagacccatgaccggctgtactacatggtggccccatctgcagaggccatgcgcatctggatggatgtcatcgtcacgggagctgagggctacactcaattcatgaactaactaccaggcacctcctgggtcccccaggtcagccccaggacaccatgccctgccacttgctgctctgcttgtccctggagacagaggcacactgggcacgggccacaaagggtcaggatgtagttgagtaccccagggcttttgtgcaagaaaacgaaattgttctatgaggagtttggtgcttgggaatcaggctccggtccctaaagagccagcagagaggaaaggaagagggagaggccttgtcgcctcctgggagtccagaagtgcaggattccctcctgggtccagcaggctgaagaggcatagctgagctgtgactctcagctctgtcctggtacccacttagcccagcttactttctctctgtaaaggacaaattatggtaccagaatctgccaaagatcccctttctcatctcatcccctctacaggggtctggggggtcctgagcagagccacgtgtagaacaggggagaggctcaggcctgcacttcccgcccccggtctgcctccttctcctcccacctcccacttttcactacttagctcaaggaccagagacctcaagtgtcattctcgaggtccagccccgtaatcatgttacaagcccatcatccttgtctccatggtggctgcttcctcaccatggttacacactaattgccatggccactctgtggctctgcccactgcttcggctgtgggccacatgagggtacatgccacccatctctccaacccaggcctgggggcctgtcacatggtgggaggagatagagttcctcccggctgcagtgtgtctccagcccccagcccagccctctcccttttactgtgccttgcttagagccagaagggatgatgtccagagatccaagaccagagagcagcatcactgaggggagaggaagctaagaggtctgccctcccattctgacaggactagttcccaataaggaacgagggtggtagctcagagtgtctggaaagaagcctgagttgggagcagggcgggcagaagcagaggccctgagctgtggtaacctcccttcagtttcccaaaggtgacgggaaagaaggacagaggatcaagtctccagctggctggcctcagccttgcgccttaacactaagccaccttccctgccctccccagcactgggcccttggttgctgggcctggctgggtgttttgcagtatttgtaagcatttcagcagaacaataaaagcattttgactatgtaaaaaaaaaaaaaaaaaaaa

SEQ ID NO: 2543 - DNA, 4198 bp, Rattus norvegicus
  Genbank Accession No. NM_134406
gacgcgctgagccgctgccgccgcgggggggaagcctgcgagtagctcgcgtgcccgcagtccgcgtaagccccgcgccccttccacccctggccaggccatggcggaacgtggaggggcgggcggtggtcccggaggcgccgggggcggcagcagtcagcggggctctggggttgcccagtccccgcagcagcagccgccgcagcagccatctcagccgcaacagccaacgccccccaaactggcccaggccacctcgtcctcctcgtccacctcggctgcggccgcctcctcctcgtcctcctccacctccacctccatggccgtcgcggtggcctcgggctctgcgcctcccggcggtccgggaccaggccgcacccccgccccagtgcagatgaatttgtatgctacctgggaggtggaccggagctcatccagctgcgtgcccagactcttcagtttgactctgaagaaacttgttatgcttaaagaaatggacaaagatcttaactcagtagtcattgctgtgaagctgcagggttcaaaaaggattcttcgctctaatgagatcatccttccagccagtggcctggtggaaacagagctccagttaaccttctccctccagtaccctcatttccttaagcgagatgccaacaaactgcagattatgttgcaaaggaggaagcggtacaagaaccggactatcttgggctataaaaccttggctgtgggactcatcaacatggcagaggtgatgcaacaccctaacgagggtgctttagtacttggcctgcatagcaacgtaaaggatgtctctgtgcctgtggcagaaataaaaatctactctttatccagccagcccattgaccatgaaggaatcaagtctaagctgtctgatcgctccccagatattgacaactactctgaagaagaggaggaaagcttctcctcagagcaggaaggcagtgatgacccattacatggacaggacctattctatgaagatgaagatcttcggaaagtaaagaagactcgaaggaaactgacctcaacctcagccatcactaggcaaccgaacatcaaacagaagtttgtggccctcctgaaacgattcaaagtttctgatgaggtgggctttgggctagaacatgtgtcaagggagcagattcgggaagtggaagaggacctggatgaactatacgacagtctagaaatgtacaaccccagcgacagtggccctgagatggaagaaacagaaagcatcctcagcaccccaaagcccaagctcaagcccttctttgaggggatgtctcagtccagctcacagacggagatcggcagtctcaacagcaagggcagccttggaaaagacaccaccagccctatggaattggcagctttagaaaaagttaagtctacttggattaaaaaccaagatgacagcttgactgaaacagacactttagaaatcactgaccaggacatgtttggagatgcgagcacaagtctggttgtaccagaaaaagtcaaaactcctatgaagtccagcaaagctgatctgcagggctccgcctcgccgagcaaggtggaagggacacacacacctcgccaaaagaggagcactcccctgaaggagcggcagctctccaagcccctgagtgagaggaccaacagctctgacagtgagcgctctcctgacctagggcacagcacacagattccacgaaaggtggtatacgatcaactgaatcagatcctggtttccgatgcagcgctccctgagaatgtcatcctggtgaacaccacggactggcagggccagtatgtggccgaattgcttcaagaccagaggaagcctgttgtgtgtacctgctcaacagtggaggtccaggccgtgttgtctgccctgctcactaggattcagcgctactgcaactgcaactcatctatgccgaggccagtcaaggtggcagctgtgggcagccagagttacctgagctccatccttcggttttttgtcaagtcccttgccagcaagaccccggactggctgggccacatgcgcttcctcatcgttcccctaggttctcatccagtggccaaatacttgggctcagtagatagtagatatagcagcacctttcttgattctgcttggagagacctgttcagtcgctcagagcctccagtgtcagagccactggatgtggtgggtcgtgtgatgcagtatgtcaatggagctaccacaacgcaccagctgcctgtggctgaagccatgttgacctgcaggcataagttccctgatgaagactcctaccagaagtttatccccttcattggtgttgtgaaagtgggccttgttgaagactcgccctccactgcaggtgatggggacgattcacctgtggtcagccttactgtgccctccacatcaccaccctcaagctcgggcctgagccgagatgccacagctacccctccctcatccccatccatgagcagtgccctcgccatcgtggggagcccaaatagcccttatggggatgtgattggcctccaggtggattactggctgggccaccctggggagcgaaggagagaaggtgataagagggacgccagttcaaagaataccctcaagagtgtcttccgctcagtgcaggtttctcgcctgccccatgcaggggaagcccagctttctggcaccatggcaatgactgtggtcaccaaagagaagaacaagaaagtgcccactatcttcctgagcaagaagccccgggaaaaggaggtggattctaagagccaagtcatcgagggcatcagccgcctcatctgttctgcaaagcagcagcaaaccatgctgagagtgtccattgatggagttgaatggagtgacatcaagttcttccagctggcagctcagtggcccactcatgtcaagcacttcccagtgggactcttcagtggcagcaaacccacctgagacctgcctcccaaccactccctcctggcactgccacccagcccagcctcctttcctagcactggggcttgcctccacttgcccagtcctgaaggacactgccactggggatgcagtcctccctgctcactgcccagccatctctgcccagctcccccctgttccaggcccagagctgggtgatcctgccttctggtgcccataattcctgtaattgaataatctgggccttccttcacctcacccctgcagcgctggtaccctttctagaaatgaaacacctggagttctggtacacagggagacagcccagcatcctacataagctggccacccagctctgcatttctaaggctctgttgcctgttgtactcaccctgccttcctccagcagggctggggcctcctgccattcctcacctgcctcacagtttcccagtagggggaaggaggatggcacctgggcatcctggagtttctgggattgaagggaccttcccagtctcccatgcatgatttcctgacacttcaagtcgcttggatgtcctgtgttttgtgtgtttttagttgtttgggtaacttgtcctgtgcacaggtccttaaggctccttctccctctgcctcccagcctcctacctaacattgctctgtggcttcatgaggtaggagacagcaaacccacccacccacccaccccttcacccctcaacacatacatcatctgtggctctcatccagtcatattgtccccctctcctgtgtcagcttgcctcctggctctgctctgtcatcccacttccttcatggcagggcagcagaatgaggcccttctccaccaggtctccctccagcagcctccttccctctctcagccatgaatgggtcccagacctacctcagcctccttatcagtgtcttcatgagaggctgaggacaagggacagatctggcccagcctccatgccctctgtgtcctatggcacctcagagcttctccgttgcccctcagtgtttcctagcagtgtggcacggaactgcacttggaacctagttttggtgttcttcacatccaaaactcttaagcccctcccgctgcccagcctgtccagagtatctcctgggcctgagaataagtggggtgggaagactggggccatgttgggttttttcattcaataaactggtgatttcttaccaaaaaaaaaaaaaaaa

SEQ ID NO: 2544 - DNA, 5551 bp, Rattus norvegicus
  Genbank Accession No. NM_134452
ctggcatggacgtacacacccgctggaaagctccgcgcccgggcgccccgctgctgtcctcgccgctgctcctgctcctgctgctgctgtgggcgccgcctccgagccgcgcagctcagccaacagatcttctggagatgctagattttcacaatttgccctcaggcgtaacgaaaaccacaggtttctgtgccactcgacgatcttccaaagagccggatgttgcctaccgagtctctaaagatgcacagctcagcatgcccaccaagcagctgtaccctgagtctgactttcctgaggacttctccatcctgacaaccgtgaaagccaagaaaggcagtcaggccttcctggtctccgtttacaatgagcagggcatccagcagttgggactggagctgggccgctcccctgtcttcctctatgaggaccacacagggaagcccgggcctgaagagtatccactcttccctggcatcaacctgtccgatggcaagtggcaccgaatcgctatcagtgtatacaagaaaaatgtcaccttgatcctcgactgtaaaaagaagatcacgaagttcctcaaccgcggcgaccaccccataatagatgtcaacggtatcatcatgtttggctcccggattctggatgatgaaatatttgagggtgacatccaacagttgctcttcgtctccgaccaccgagctgcctatgattactgtgagcactacagccccgactgtgacacagcggtccctgacacacctcagtcacaggaccctaacccagatgaatattacccagaaggagagggtgagacctattactatgagtacccatattatgaagaccctgaagacccgggaaaggagcccgccccctctcagaagccagtggaagccgccagagaaaccacggaggttcctgaggagcagacccagcccccatccgaagcccctacagtgcctgagaccagtgacacggctggcaaggaggacaatccagggatcggggactacgactatgtgcccactgacgactactacactacatccccgtatgaagacttcggctatggcgagggcgtggagaaccccgaccagcccaccaaccctgactcaggggccgagatccccaccagcaccagtgttacctccaattcctccaatccggctccatctccagaggaagggaaggatgacctgggaggtgagttcaccgaggagaccatcaagaatctagatgaaaactactacgacccgtactttgacccggactccgactccaatgtctctccatcggagatagggccaggcatgcctgctaaccaggacaccatctatgaagggattggaggaccccgaggtgagaaagggcaaaagggagaaccagccatcattgagccgggaatgctgatagaggggccccctggccctgaaggccctgctggtcttccaggacctccaggaactacgggtcctactggccaaatgggtgaccctggagaaaggggtccccctgggcgcccaggtcttcctggggctgatggcttgccaggtccccccgggaccatgctcatgctgccgttccgttttggaggtggtggcgacgccggttctaagggccccatggtctctgcccaggaatcccaggcacaggctatccttcagcaagccaggttggcactaaggggaccagctggtccaatgggtctcaccgggagacctggccccatgggtcctcctgggagtggaggtttgaagggtgagccaggagacatgggacctcagggtcctcgaggtgtgcaaggtccacccggcccaacagggaagcctggaagacggggccgtgctgggagtgatggtgccagaggcatgcctggacaaacaggccccaagggtgaccgtggctttgatggtctggctgggttgccgggagagaaaggccatagaggtgaccctggtccttctggcccgccgggactcccaggagatgatggagaaaggggtgacgatggagaagttgggcccagggggctgcctggggagcctggaccacgtggtctgcttgggccaaaaggcccccctggcccacctggacctcctggtgtgacgggtatggatggccagcctggccccaaaggaaatgtgggtccccagggagagcctgggcccccaggacagcagggtaatcctggtgcccagggtcttcccggtccccagggtgccattggtcctccaggagaaaagggtcctttggggaaaccaggtctcccaggaatgcccggagctgatggacccccggggcaccctggcaaagaaggtcctccaggagagaaaggaggccagggtcctcccggcccccagggtcccattggctacccaggtccacgaggagtcaagggggcagatggcatccgagggctgaagggcaccaagggagagaagggtgaagacggcttccctgggtttaaaggcgacatgggaataaagggtgaccggggggagatcggcccacccggcccccgaggagaagatggtcctgaaggcccaaaaggtcgaggtggtcccaatggtgatcctggtcccctggggcccaccggggagaaggggaagctcggagtgccaggattaccagggtacccaggaagacaagggccaaagggttctattggattccctggcttcccgggcgccaacggagagaaaggtggcagggggacacctggaaagccaggaccacggggacagcgaggcccaacgggcccgaggggtgaacgaggcccacggggcatcactgggaagcctggccctaagggcaactcaggaggtgatggcccagccggccctcctggtgagcggggacccaatggaccccaaggccccaccggcttccctggacctaagggtcccccgggtccaccaggcaaggacgggctccccggacatcctgggcagagaggggagactggtttccaaggcaagactggccctccaggccctccaggagtggttggccctcagggtcccacaggcgagacgggtcccatgggggagcgtggccaccctggtcctccaggcccccctggtgaacagggcctcccaggtgctgctgggaaagaagggacgaagggtgacccaggtcctgctggcctccctgggaaggatggacctccaggattgcgtggattccctggggaccgagggctccccggccccgtgggagcactcggactgaaaggcagcgaaggcccccctggccccccaggtcctgcgggttctccaggggagagaggaccagctggtgctgctggacccattggaattccagggagacctgggcctcagggacctccggggcctgctggagagaaaggggttcctggagaggaaggtccgcaaggcccggctggccgagatggcctgcaaggtcccgtggggctccctggaccagccggccccgtgggtcctcctggagaagatggagataagggagagatcggagagcccgggcagaaagggagcaagggcgacaaaggcgagcagggtcctcctgggcctaccggtcctcaaggccccactgggcagccaggcccttcgggagcagatggtgaacctggccctcgtggacagcagggcctgtttgggcagaaaggagatgaaggttcaagaggtttcccaggaccgccagggccagtgggcttgcagggtttaccaggacctccaggagaaaagggtgagacaggagacgtgggccagatgggccctcctggtccaccaggcccccgaggaccctctggagctccaggagctgatgggccacagggtcctccaggagggattggcaaccctggtgcagtcggagaaaagggagagcctggcgaagctggagagcctggccttccaggagaaggaggtcccctgggacctaaaggagaaagaggggagaagggagaggctggcccctctggtgctgctggaccccctggacccaaaggcccacctggagatgatggccccaaaggcagccccggccccgtgggctttcctggagaccctgggccccctggagagccaggcccagcaggtcaagatggcccacctggtgacaaaggggatgatggagaacctgggcagacgggatccccaggccctactggtgaacctggtccatctgggcctccaggaaagaggggtccaccgggccctgcaggccctgaaggcaggcagggggagaaaggagccaagggagaagctggcttagaaggccctcctgggaagactggccccattggtccccaaggggcccctgggaagcctggccctgatggtcttcgtgggatccctggtcctgtgggtgagcaaggcctcccaggatccccaggccctgatggtccacccggccccatgggtcctccaggactccctggcctcaaaggagactccggtcccaaaggtgaaaagggccatccgggcctgattggactcatcggacctccgggcgaacaaggtgaaaaaggtgaccgaggactcccaggcccccagggctcatctggtcctaaaggagaacagggcattacaggtccttctggcccgcttgggcctcctggtcccccaggcttgccgggccctccaggtcccaaaggtgctaaaggttcatcgggtcccactggcccgaagggcgaggcaggccatccaggactccctggtccacccgggcctccaggcgaggtcatccagcccctgccaatccaggcgtccaggactcggcggaacattgatgccagtcagctcctggatgatggggctggggagagctacgtggattatgcagatggcatggaagagatctttggttccctcaactccctgaagctggagattgagcagatgaagcggccactgggcacacagcagaacccagcccgtacctgcaaggaccttcaactctgccatcctgatttcccagacggcgaatactgggtcgatcccaaccaagggtgctccagggactccttcaaagtctactgcaatttcacagctggagggtccacgtgcgtcttccctgacaagaagtctgagggagccagaatcacttcttggcccaaagaaaacccaggttcctggttcagtgaattcaagcgtgggaaactgctctcctatgtggatgctgaaggcaaccctgtgggcgtggtacaaatgaccttcctgcggctgctgagtgcctctgcccagcagaacatcacctacaactgctaccagtccgtggcctggcaggatgccgccacaggcagctacgataaggctatccgcttcttgggctccaacgatgaggaaatgtcttatgataacaacccctacatccgtgccctggtggatggctgtgctaccaagaaaggctaccagaagacggtgctggagattgacacgcccaaagttgagcaagtccccattgtggacatcatgttcaccgactttggtgaagcctcacagaaatttggatttgaagtagggccagcttgcttcctaggctaggagctgtgagcccaccgtctacc

SEQ ID NO: 2545 - DNA, 3044 bp, Rattus norvegicus
  Genbank Accession No. NM_134455
tgcactccagccatccagccatggctccctcacagctcgcgtggctgctgcgcctggccgcgttctttcatctgtgtactctgctggcgggtcagcacctcggcatgacgaaatgcaacatcacgtgccacaagatgacctcgccaatcccagtgaccttgctcatccactatcaactgaaccaggagtcctgcggcaagcgcgccatcatcctggagacgagacagcacagacacttctgtgctgacccaaaggagaaatgggtccaagacgccatgaagcacctggaccaccagaccgctgccctgactagaaatggtggcaagtttgagaagcgtgtggacaatgtgacacctaggatcacctcggccaccaggggactgtccccaactgccctggcaaagcctgagtcagccacagtggaagaccttactttggaaccgactgctatttcccaggaggcccgaaggcccatggggacttcccaagagccaccagcagcagtgactggatcgtctccctcaacttccaaagctcaggatgcagggcttgccgccaagcctcagagcactggaatttctgaggtggctgctgtctctaccaccatttggccgagttctgctgtctaccaatctggatctagcctctgggccgaggaaaaagctactgaatccccccccactatagccctatctactcaagcgtccaccacttcaagccccaagcagaatgttgggtctgaaggccagcccccatgggtccaggagcaggactccactccagagaaatctccagggcctgaggagacaaacccagttcatactgatattttccaagacagaggacctggcagcacagtccatccctcagtggctcccacctcctctgaaaagacccccagcccggagctggtggcctcgggcagccaggctcctaaggtagaggaacccattcatgccactgcagatccccagaaactgagtgtgtttatcactcctgtccctgactcccaggcagccacccggaggcaggcagtggggttactggcctttcttggtctactcttctgtctgggggtggccatgtttgcctaccagagcctccagggctgtccccgcaaaatggcaggggagatggtggaaggcctccgctacgtcccccgtagctgtggcagtaactcgtacgtcctggtgccggtgtgagctgcctgcttgcctgcctgtgtccagagtgtgattcagacagctgtctggggacccccatcctcatacccaccttcatccacgctgggagaatgggaatgcagaagctagatcctccaggggccatgtgctccaacccccgaggagtggccctggaggccaccctagaccattattcacttatcagagacagacagagcaggtggccttccagctcccccatatttgaaagaatcctctgctgctggctggttagaggggcccttgacatcccaaactctatgagcaattatttattggattcccagccccctgagacacccgtttccccgtgcgcaccgtggtccacccatcttacaagcagcagccaggcctctctgcctgtcccctgacctcctcgtgtctcctggctttgctgcagtcgccagccctgtctcctccccggccagctgcggtgctatctatcccggtctctctctctcgtgtacagagccatcaccaccatcaccaccaacaactcgttctgtctttgcttgcatgaggttaatgctgtgttttctggagctctctgggacgggagatgagcttctgtgagggtttaaagtgttcctccccagactttgatgtgccgtgaagcatgctgcctctgaaggaaggctctggtccccactccgctgccagcacaacaaagtgccccacctgtaaaggaaaagagactcggcccagagctggcaaaaacccatggccctgacatcatcactttctctgagatctttgtccccatccctggatgccaccccccccccccagcccttatcaacatgaatagtcactgccattccactggactgacacttttgtatgctgtgattctgagggctggcaagggatgacttgagagtgcagatcctacccatgggcccccaaatggaggctgagctggggacctgcaggaagagaggccaactcagaaggctccgctgtgttctcactggcacccctcccctgtgcaccaaggtgacagtcacaggtctgccctgcctgaagaacaagccacagaaggaagattatgacaagtccctgggaggccaaggatccagggcaaaccctggagtggccacacacccaatttcagcttagggacttgtgcatgtgtgtacttgcacagcccagatcattcagaagctgccaggatcctttcctacatctgagagcgcagttcctgccaaggtctcaccttcgcctcacttcaggcagggcagaactcccataacattctccaagagccctgtgacgtgttctggaagggactctgccctgggcacaaagtgtctactgaagcagagagcagcgccccagccccagccccagcgccccagcgggagctgtaccggcagaccacgccctgggggggagggccctccgtggcagctttccgctctgaatagctccaaccgtcacctttggagcctcccaggggcgggcttcacccagccagtgactcactccttgataggtggaagctcagaacaggtggtctcgtcccagagtgaggaagccagccccttggcgaccctcctcttgggaagcttgtgggaggctctggtctggctccagagtactagttgtaggcctgaggagcagcagcccgagtgcactatatcctggttcttcggtggggagccttcaagggttgggacacccatggttggactttgttggttcccgcgcctcgtgggccaaaacaatctgaggaggactttggaaggagttggtttttcaagcatcattaccaatgtctgtgccattttgtattttactaataaaattttaaagtcttgt

SEQ ID NO: 2546 - DNA, 3052 bp, Rattus norvegicus
  Genbank Accession No. NM_138518
tcagagttccgcgcagaaccttccagtgcccagccatacttcaggagtgccctgtccccttagtcgtggctgcaggcgtggagccatgagctgtcttctgaacaatatggtcccggtggggctggctccgctggtctgcggagtacaggcctttttccttcccaacaccatgagcctggagaggctgctcagcaagtaccagcacacagagccacactcacgcgtgcgcagggccatccccatgtcagaccgtcagaaatcctcatgctgcacaacaagctgcgaggtcaggtgtatccccctgcctccaacatggagtacatgacctgggatgaggagctggagaggtcggcagccgcgtgggcacagaggtgcctgtgggagcatgggcccgccagccttctcgtgtccatcgggcagaacctggctgtgcactggggcaggtaccgctctcctgggttccacgtgcagtcgtggtatgacgaggtgaaggattacacctacccgtacccccacgagtgcaacccatggtgccccgagcgctgctcaggagccatgtgcacccactacacacagatggtttgggccaccaccaacaagattggctgtgctgtgcacacctgtcggagcatgagcgtctggggagacatctgggagaacgccgtgtatctcgtctgcaattattctccaaagggaaactggattggtgaggctccctacaaacatggccgcccctgctctgagtgtccgtccagctatggaggtggctgccggaacaacctgtgttaccgagaagagcactaccatcagaaaccggagtggatgagatgaacgaggtggaatcaccccctgctcccgaggaaacccatgtctgggttcaacccagggtggtcaaaccctcaaagaccaagaagaccccagtcgtcaacttcatgacccaagtggtccactgtgacacaaagatgaaggactcatgcaagggatccacatgtaacaggtaccagtgcccagcaggctgtctgaacaacaaggcgaaggtctttggctctctgttttatgaaagttcttccagtatatgtcgagctgctatccactatggtgtcatcgatgatcgaggtggcctggtggatgtcaccaggaatgggatggtacccttctttgtcaaatctcagaaaaatggcttgaagtccctgagtaaatacaagccgtctagctccttcactgtgtccaaagtgaaagagacggctgtggactgccacaccacagttgcacagctatgccccttcgagaagccagccacccactgcccgagagtccggtgtccttcacgatgtggagaggagccatcctattgggcccctgtgtatggaaccaacatctacgctgacacttccagcatctgtaaggcggctgtgcatgcaggcgtcattgtcgacgaggttggtggctatgcagatgtgatgcccgtggacaaaaagaagagctacgtgggctccctcaggaacggggttcagtcagagagcccgagcactcctcagaacggaaacgacttccggatcttccccgtcaggcagtgaatatggagacctggggagaagggggtgtcgtctactgggattcgggggtcctgctttttatctgtactttgtcctttgggggtgggagggtaacagagagtcaagaatcttcctttcggtgtcgttgactgtcctgggcctccgtggcttttggtgacggtgacagagcaccttcccctcgtgagcagcatgccgtggagtctcttgctggacaaccagtgcccagactggccaggtggcggtccccatctggtggctcatctcctctcaggagatgctcaccgagacactctttgccacattttctttggtgttggaggggggaaggctttcgaactcttgaggatacagggtggagattcgttgtgaagggggctcttgtctggatgacaagagtggacagccctaaggttacagtccgtcctaccaacagagaaatagggtctgtgtttgctggtcagacagatgggctgcagggagaagccctgggcaaaacctgggctctgccctggtggtatccgtgctcatgtccccaaccttcttggcagtcacgtgttcgtattgacagcagagctggtctatttaaagttggtagcactccagagatttatcttttctttgtccttgtccttgtccttgtggcccgttttcacatgacctttggtctcatggaagaccagtgcatcaggagccttccccaccattccgtgtccctgtgtcgagcatctgccccaccccaaggaggtctagattgtcctcctttggggcttggctttgtaagaggctccaggtcttagatgtctgcttactccttagaacaagggctctctcacggttgctgttagagtggcagctcgacatcgcttccccatggtttgggtgacctagtttttagctgtgggaggaccggattcctggcgcattcctcctgggggttaatggagtgacctgtggttgtaaaaccacccatgacacaccagccaccagagagagaggggcagggacacacaggaagaacccctcagcgcttgccagagtcccgggctccaagagtgtggtgagtcctggcttccatcacttaggagcctggtccaaacccgctgtaaaatgaaacctgcttttgtaaacagctttctctagagaaggtggaatcccaccccagtcctggggatggggcacagttgcctgtgaatgttggcctcaaacagggtttcatgatccagccaaacatttcttagacaaaagaaagggggtgggagtagaaaataaaacagaatgctgtcccccagttgaaaggctggggaggtgacttggtgattaacagctctaccagaggacctgagctcagttcccacgactcacagactataactataacccacctatgaccaactctaggagatccatgatctccacagacgccacacgcatccacatgagcaaaagtacaaatggtcctaaaaaaaaaaaaaaaa

SEQ ID NO: 2547 - DNA, 1544 bp, Rattus norvegicus
  Genbank Accession No. NM_138531
cgcgatctagaacccgactgtcatccttcaggaaagaactcatcggtccaatgtctgaccatgcagatgtgagcctcccaccccaagaccgggtgaggattctgtcgcaactcggtagtgcagttgagttaaatgaagacattccgccccgtcgctactttcgttccggtgttgagatcatccgcatggcatccatttactctgaagaaggcaacattgaacatgcctttatcctctacaacaagtacatcacgctgtttattgaaaaacttccaaaacaccgagactacaaatcggccatcattcccgagaagaaagacgcggtcaagaaattaaagaatgtcgctttccctaaagcggaagagctgaagacagaactcttgaagagatacaccaaagagtatgagcagtataaggagcgaaagaagaaggaagaagaggaacttgcccgaaatatcgccatccagcaagaactggaaaaagaaaagcagagagttgcacagcagaagcagaagcagctcgagcaggagcagttccatgcctttgagaagatgatccagaagcaggagctagagaaagagcggctaaaaattgttcaagagttcgggaaggtagaccctggcccgtgcgggcctctgctccctgatctggaaaagccctgtgtagatgtggcccccagttcacctttctcgcccacgcagacttcagactgtaacacaaccctgaggccagctaagccacctgtggtggacaggtccctcaaacctggagcattaagcgtcatagaaaatgttcccaccattgaaggcctgcgccacattgtggtgccccgcaatctgtgctcagaatttctccagcttgccagcgccaacactgccaaaggcatcgagacctgtggagtcctctgtggaaaactgatgagaaatgaattcacaatcacacatgttctcatccccagacaaaatggtgggcctgattattgccacacagagaatgaagaagaaattttctttatgcaggatgatcttggactcctcactcttggctggatccacacccatccaacccaaacggcctttctgtccagtgtggatctgcacacgcactgctcctaccaaatgatgttaccagagtccatagcaattgtctgctcccccaagttccaggagactggattctttaaattaactgactatggccttcaagagatttcaacctgccggcagaaaggctttcacccccatggcagagacccaccgctgttctgtgactgcagccatgtcactgtcaaagacagaattgtgacgatcacagaccttcgataaatctcagtcatgaaccaggaggtggcccactgggtaaacacacttgccaccaagcccaacagcccaagttctattgctgggatccccccaagttgtcctctaacctccatttgtgtactgtggtatgtgtgtacccacatatacacacacagacacagacacacacacatattaattaatttaaaacaaataaatgtaaattacaaaaaaaaaaaaaaa

SEQ ID NO: 2548 - DNA, 5433 bp, Rattus norvegicus
  Genbank Accession No. NM_138535
caggcagcaacagccggtggcacagcacagaagccgcctctgctgatagagaatggcccgcagcccgggtgagcctgctgtagccttctccctgactcagactccaccccatccctggctcagctgagtgtcagcggggccttctgcttcccctggaggcaggcaggacctgaccagactgtcctgggaagtgacgatgggccttactcaaaggggggaaaggacacagcggggactgatggggccctggtgtgccgccgccagagcattccagaggagttccggggcatcaccatggtggagctgatcaagcgtgagggcagcactctgggcctgactatctcaggagggactgacaaggacgggaagcccagagtctccaacctgagacccgggggccttgcagccaggagcgatctactgaatgtgggcgactatatccgctcagtgaatgggatccgtctgacccggctccgacatgacgagatcatcacattgctgaagaatgtgggcgagcgcgtggtgctggaggtggagtatgagctgcccccgcccgctcccgaaaacaacccgaggatcatttccaagacggtggacgtctccctctacaaggaaggcaacagttttggctttgtcctcagaggaggtgcccatgaggacctgcacaaatcccgcccattggtcctgacttacgtgcggcctggtggcccagcagacagggagggttccttaaaggtgggcgacaggctgctcagcatagatgggatcccactgcacggggccagccatgctaccgcaatagccaccctgcagcagtgcagccatgaggccctcttccaggtggagtacgatgtggccaccccagacacggtggccaatgcttcaggccctttggtggtagaaatagccaagaccccaggatctgccctggggatctctctcaccactggctcccaccggaacaaaccagctatcactatcgaccgcatcaagccggctagcgtggtggacaggagtggtgccctgcatgctggagaccacatcctggccatcgatggcaccagcacagaacactgctctctggtcgaggccacgaagctcttggccagtgtgaccgagaaagttcgactggagatcttgcctgcaccccagagtcggcggcccctgaagcccccagaggcagtgagaatacagaggagtgagcaactgcaccactgggacccctgtgttccctcttgccatagcccaaggccaagccactgcagggcacccacctgggcacctggaggccaggaccagagccgatccgtgtcctcgactcccttctcctcgccaactatgaaccctgcctttccctgtgccaacgccagcaccctgcccagaggacccatgagccccagaacaacagcggggaggagaaggcagcgaaggaaagaacacaggagctctttgtcactggcctccagcacggtagggcccggtgggcagatcgttcacacggagacgacggaggtagtgctctgtggagaccccctcagtggcttcggcctccagctgcaggggggcatttttgctaccgagaccctgtcctccccacccttggtgcgatttattgaacctgacagccctgctgagaggtgtggtctgctgcaggtgggggaccgcgtcctagccataaatggcattgctactgaggatgggaccatggaggaagccaaccagctgttgcgggatgctgcactggcccgcaaagttgttttggagatcgagtttgatgtggcggagtctgtcatcccaagcagtgggaccttccacgtgaagttacccaaaaggcgtggtgtggagctgggcatcaccattagctcggccagcagaaagcgaggggaacccctgatcatctctgacatcaagaaaggcagcgtggcgcacaggactggcaccctcgagccgggcgacaagctgctggccattgacaatattcgcctggaccattgccccatggagtatgctgtgcaaatcctgcgccaatgtgaggacctggtgaagctgaagatccggaaggacgaggacaactcagatgagcaggagagctcgggcgcagtcagctacacagtggaactgaagcgctatggcggacccctgggtatcaccatctccggtacagaggaaccttttgaccccatcatcatctctggtctcaccaagcggggtctggctgaaaggactggagccatccatgttggggaccgcatactggccatcaacagcgtgagcctcaagggccggcccctgagtgaggccattcaccttctgcaggtggcaggggagactgtcacactgaagatcaagaagcagctggaccgtccccttctcccccgccagtcaggcagcctcagtgaggccagtgatgtggatgaggacccccctgaggccctcaagggaggcttgctgacaacccacttctcacctgctgtacccagcgtggacagtgctgtggagtcctggggcagctctgccacagagggtggctttgggggctcaggctcctacactccgcaggtggcagtccggagtgtgactcctcaggagtggcgttccagcagactgaagagtagccccccaccccttgagccccggaggacgagctacacaccgggccccactgacgaaagcttcccagaggaggaagagggggactgggagccaccaatgaggcatcctgtgtcaccgctctccaccccgtctcatctgcccctgttctaattggctaccaacagtcttggtcgcccctaactgcgtcttccccaccccattctgtgtcaccaaccactgcccagcactgggccctgggcaacgaagactcctcaggcccagcccacccaccctcccacctgccaggagttgacgctgtggttcctgttgcagcccagcccctggccccgcccgagaggagggcttctggagagtgcttggagaggcccttgaagacctggagtcctgtggtcagtctgaactgctaagggagctggaggcttccatcatgacaggcactgtacagtcggtagctgtggatggcaggcctggctctcggccctggcgccggagccgggaagtcggaacatccccggaagacctgcaggagctgctgttgccaacgcccctggagatgcacagggtgaccctgcacaaagacccggtgaggaacgactttggtttcagtgtctcagatggcctcctggagaagggtgtctatgtccacatgtgcgcattgatgggccagctcagcacggaggcctgcagccctttgaccgtctcctgcaggtcaaccatgttcgcactgggacttcgattgctgtctggccgttccactactggcagaggtggggacatccttgagctggtggtcagccgaaaccatctggcacagagccgcagacaccagagcaccgggccccagtagtccccagatgatctgaggtcattatgtaagtcagctggcggagtgcccccagtcatcgattatggcctgcagattcacatccggtagagtggcatcttcaagttgggtcttcaggatgctcagagaaccccacaggaaaggggtcatccctgctgctcagctaggagagcccagctccctgtgcagtcatctcagagcagcgaacagagtggggacggcccactccgtgtggtaatggatgatgccagtatttcccattgggaagttaataagctgtaggtcgacaattctgctctgtggaaagaggcatttggcgacccagctgttcagatggtacccagtgcacagggaccctgccaccgggaaagatatggcacaagaacagtgtcctcccttctcccaaatggtggtgttttgagagcctccagcacctagtgaccatactgaggaaccccaattagggacaatctagggtgccagagaatgcttgccccttcctttgggttggtctttcaattatttcacgggtgattctgaacctcagagcagaactgtggccatcaaccctcctgtcccacaaaaccttagcccaagtccttgcccagaggagggcacagctcgggtcaaacggtccaggagcatccacacacctgccattccagcacatatggtaaaccttgggaagagactgagccacagttctgcccctgaccccatcagaggaagagaggaagaggaaaggagctgacatggagggaggtcagctgaaggatgagagagtggctaactggagcagtgtccaaggaggctattcaaggaggtccccagcatcccttaactctgggctcctccatctctgctaagcagaacccttccagcttcaagcaagactcaagacacttccttcccagcagtctgagctgttctggagactggcttcatgtttgcccagcttaaggtctcaaggacctgcgggaagcctccaaccctgccctgtcacccctctgtgcccttgaagctcactgctagaaagcactccctgttcaagaggacagatgaggtcccagaagccattctttccccgttctcttcttggctgtataaccttgagtaaagctgaaaagacacagggcgagctccagctgcccactaagacacttcagctctctgcttttcctagcttcccccatatcctgcccttcatgatggcttccccagggacccttcaggcaacccagtgactctactttcactgccccagggtagaaagatactacccacccatcatgggcaccaaacaaagaccttcagcttcactagcagagaagtgactcctagccaccagctcacctgatcctgtgtgaccttgggcagatggctcagcctctggatttctggtgtgtggcataactgactgtaccctgaaggcctcttagcttgggaaatctgtgttccacttaatgactccaggctctgaaaatgcaacccctcgaccactgccctcccctcgggctgaggctctcccatcctcccagacgtatgcaactaggccaagcgggtggacctcctggctgtggcctgaggccttctcatatgcaatatacccccctggcttctcacaggggtgtttgccccacacaacatccctagcccccaccccagtgagcatcctgcctgcctatgcattttgggtacctcccctgtgacacccacccccagagctgtatttttctctggctaagattagaacatattccttgtaaagtatttttctatgcgggttttcttagggctcccaggaagcacccagcacacccatggccccactgtacaggttgtttctggtctgtctggggcccacctataaatctttgtcccaccaggcatcacagtgactggggggaggttgagtgctattggggtgattttttttaaataaaattggttaaatgaaaaaaaaaaaaaaaaaaaaa

SEQ ID NO: 2549 - DNA, 1178 bp, Rattus norvegicus
  Genbank Accession No. NM_138549
agaagggacgcacgcatagagaggggcggagccggagccctggagtgctgctccttgtgtgtgtggggctgggtggtggttggtgcggcagggcggctactcagctgcagcagtgcaggtgccatcctgtggaagaaccatgaagcactacgaggtggagattcgggatgcaaagacgagggagaagctgtgcttcctggacaaggtagagcctcaggccaccatttctgaaatcaagacccttttcaccaagacacacccgcagtggtatcctgcccgccagtccctccgcctggaccccaaggggaagtccctgaaagatgaagatgtgttgcagaagcttcctgtgggcaccacagctacgctctacttccgggacctcggggcccagatcagctgggtgacggtcttcctgacggagtatgctgggccccttttcatctacctgctcttctacttccgggtgcccttcatttatggccgcaaatacgactttacatccagtcggcatactgtggtgcacctcgcctgcatgtgccactccttccactacatcaagcgcctgctggagactctcttcgtgcaccgattctctcacggaaccatgcccctgcgaaacatcttcaaaaactgcacctactactggggctttgctgcgtggatggcttattacatcaaccaccctctctacacaccccctacctatggagttcagcaggttaagctggcactggccatttttgtgatctgtcagcttgggaacttctctatccacatggctctccgggatcttcgaccagcggggtcgaaaaccaggaagatcccataccccaccaagaaccccttcacctggctgtttctgttggtgtcctgtcccaactacacttacgaggtcggctcctggattggctttgccattatgacacagtgtgtcccagtggccctcttctccctggtgggcttcacccagatgactatctgggccaagggcaagcatcgcagctacctgaaggagttccgtgactacccacccctgcgcatgcccataatccccttcctgctctgagcagctcctcccgagctcagcccagtaatgccctccacctactacccctgtcctgatgtggctggccaaggctctccagcagcaacaataaaacctgcttacccaaaaaaaa

SEQ ID NO: 2550 - DNA, 389 bp, Rattus norvegicus
  Genbank Accession No. NM_138826
tcccgacttcagcagcccgactgccttcttgtcgcttacaccgttgctccagattcaccagatctcggaatggaccccaactgctcctgctccaccggcggctcctgcacctgctccagctcctgcggctgcaagaactgcaaatgcacctcctgcaagaagagctgctgctcctgctgccccgtgggctgctccaaatgtgcccagggctgtgtctgcaaaggtgcctcggacaagtgcacgtgctgtgcctgaagtgacgaacagtgctgctgccctcaggtgtaaataatttccggaccaactcagagtcttgccgtacacctccacccagtttactaaaccccgttttctaccgagcatgtgaataataaaagcctgtttattct

SEQ ID NO: 2551 - DNA, 2571 bp, Rattus norvegicus
  Genbank Accession No. NM_138827
ggggcgggccaatggcggcggtcctataaaaaggcagctccgcgcgctctcttcctaagaacacaagaatcccttgtggagtgtcggtttaggttgcagggtcttaagtgagtcagggcgcggaggtccggcgggagacgcatagtcacagaacgtccattctccgtttcacagcccgcacagcttgagcctcgagcgcagcgcggccatggagcccagcagcaagaaggtgacgggccgccttatgttggccgtgggaggggcagtgctcggatccctgcagttcggctataacaccggtgtcatcaacgccccccagaaggtaattgaggagttctacaatcaaacatggaaccaccgctatggagagtccatcccatccaccacactcaccacactctggtctctctccgtggccatcttctctgtcgggggcatgattggttccttctctgtgggcctctttgttaatcgctttggcaggcggaactccatgctgatgatgaacctgttggcctttgtgtctgccgtgcttatgggtttctccaaactgggcaagtcctttgagatgctgatcctgggccgcttcatcattggagtgtactgtggcctgaccaccggctttgtgcccatgtatgtgggggaggtgtcacccacagctcttcgtggagccctgggcaccctgcaccagctgggcatcgtcgttgggatccttattgcccaggtgttcggcttagactccatcatgggcaatgcagacttgtggcctctactgctcagtgtcatcttcatcccagccctgctacagtgtatcctgttgcccttctgccctgagagcccccgcttcctgctcatcaatcgtaacgaggagaaccgggccaagagtgtgctgaaaaagcttcgagggacagccgatgtgacccgagacctgcaggagatgaaagaagagggtcggcagatgatgcgggagaagaaggtcaccatcttggagctgttccgctcacccgcctaccgccagcccatcctcatcgccgtggtgctgcagctgtcccagcagctgtcgggcatcaatgctgtgttctactactcaacgagcatcttcgagaaggcaggtgtgcagcagcctgtgtatgccaccatcggctcgggtatcgtcaacacggccttcactgtggtgtcgctgttcgtcgtggagcgagctggccgtcggaccctgcatctcattggtctggctggcatggcgggctgtgctgtgctcatgaccatcgccctggccctgctggagcagctgccctggatgtcctatctgagtatcgtggccatctttggctttgtggccttctttgaagtaggccctggtcctattccatggttcattgtggccgagctgttcagccaggggccccgacctgctgctgttgctgtggctggcttctctaactggacctcaaacttcatcgtgggcatgtgcttccaatatgtggagcaactgtgtggcccctacgtcttcatcatcttcacggtgctgctggtactcttcttcatcttcacctacttcaaagttcctgagaccaaaggccggaccttcgatgagatcgcttccggcttccggcaggggggtgccagccagagcgacaagacacctgaggagctcttccaccctctgggggctgactcccaagtgtgaggagcccacagccagtcccgcctgctcccagcagccccgaggatctctctggagcacaggcagctagatgagacctcttccaaactgacagatctcgggcgagccgggcctgggcacctttcttcagtcagcaatgaagtccagaagaatattcaggactttgatggctccagaatttttaatgaaagcaagactgttgctcagatctattcagataagcagcagattttataatttttttattactgattttgttattatttttttttttatcagccactctcctatctccacactgtagtcttcaccttgattggcctagtgcctgagggtggagaccacgccctgtccagacacatgccttctttgccaagctaatctgtagggctggacctttggccaaggacacacgaatactgaacaatggctaggaggctttaccgcaggaggcggtagctgccacccacttctgcaggcctggatctcgacaccataggggtccaggctccatttaggattcgcccattcctgtctcttccaactcaaccaaccactcgattaatctttccttgcctgagaccagttgaaagcactggagtgcagggaggagagggaagggccaggctgggctgccaggttcaggtctcctgtgcactgagggccagacaaacaccatgagaaggacctcggaggctgagaacttactgctgaagacacggacactcctgccctgctgtgtatagatggaagatatttatatattttttggttgtctattaaatacagacactaagttatagtatatatctggacaaacccacttgtaaatacaccaacaaactcctgtaactttacctaagcagatataaatggctggtttttag

SEQ ID NO: 2552 - DNA, 936 bp, Rattus norvegicus
  Genbank Accession No. NM_138828
atgaaggctctgtgggccctgctgttggtcccattgctgacaggatgcctggccgagggagagctggaggtgacagatcagctcccagggcaaagcgaccaaccctgggagcaggccctgaaccgcttctgggattacctgcgctgggtgcagacgctttctgaccaggtccaggaagagctgcagagctcccaagtcacacaggaactgacggtactgatggaggacactatgactgaagtaaaggcatacaaaaaggagctggaggaacagctgggcccagtggcggaggagacacgggccaggctgactaaagaggtgcaggcggcacaggcccgtctgggagctgacatggaggatctacgcaaccgactcgggcagtaccgcaacgaggtaaacaccatgctgggccagagcacagaggagctgcggtcgcgcctctccacacacctgcgcaagatgcgcaagcgcctgatgcgggatgcggatgatctgcagaagcgcctagcggtgtacaaggccggggcacaggagggcgccgagcgcggtgtgagtgctatccgtgagcgcctggggccactggtggagcagggtcgtcagcgcacagccaacctgcgctggcgccgcccagccccgcgcgatcgcgcccaggctttgagtgaccgcatccgagggcggctggaggaagtgggcaaccaggcccgagaccgcctagaggaggtgcgtgagcagatggaggaggtgcgctccaagatggaggagcagacccagcagatacgcctgcaggccgagatcttccaggcccgcatcaagggctggttcgagccgctagtggaagacatgcagcgccagtgggcaaacctaatggagaagatacaggcctctgtggctaccaactccattgcctccaccacagtgcccctggagaatcaatga

SEQ ID NO: 2553 - DNA, 1830 bp, Rattus norvegicus
  Genbank Accession No. NM_138839
tgcgatccggagaagccggggtctgagcggctcctccagagttactgatctatgaaatggcagagaatggaacaaattgtgaccagagacgtggagcaatgagtaaggaacagcataatgggagtttcacagacccctcttcagtaaatgagaagaagagaagggatcgggaagaaagacagaatatcgtcctgtggagacagccactcattaccttgcagtatttctctctggaaactcttgtagttttgaaggaatggacctcaaaattgtggcatcgtcaaagcatggtggtgtcctttttcctgctgcttgctgcgcttgtagctacgtattatgtggaaggagcgcaccagcagtatgtgcagcggatagagaagcagtttcttttatatgcctactggataggcctggggattctgtcctctgttggtcttggaacaggattgcacacctttctgctttatctgggcccacatatagcttcagttacattagctgcttatgaatgcaattcggttaatttccctgagccaccctatcctgaccagattatctgcccagacgaagaaggcactgaaggagccatatctttgtggagtatcatctcaaaagttagaattgaagcctgcatgtggggcattgggacagcaattggggagctgcctccatatttcatggccagggcagctcgcctctcaggtgctgaaccagatgatgaagagtatcaggaatttgaagaaatgctggaacacgcagagactgcacaagactttgcatcacgagctaaactggcagttcaaaaactagtacagaaagttggattttttggaattttggcctgtgcttctattccaaatcccctgttcgacctggctggaataacatgtggacacttccttgtacctttttggaccttctttggtgcaaccctgattggaaaagcaatcattaaaatgcatatccagaaaatctttgttatagtaactttcagcaaacacatcgtggagcagatggtggctttcattggggctgtacccggcataggtccgtctctgcagaagccttttcaggaatacctggaggcccagcggcagaagctccaccatagaagcgaagcaggcacagcgcagggagaaaactggttatcctggacgtttgagaagctggtcgttgccatggtgtgttactttatcctgtctatcattaactccatggcacaaagctatgccaaacgaatccagcagcgcttgaactcagaggagaagactaaataagcagagagtttttatctgcagaagttagcgtggtggagcctgccttacatcgggagggctctcaccaggaaggaagatccccatttccaacctgtactgatttttaaaacatttctccctgaaagcagtttagtccacattttacactgacatacttttgctttctttgttaaggtaaggtctccaccctcgattcaatccacattgtattccttagggtggatatgatgttctgctgcaaacttaacaaaactggccttctgacactttcacagggccacatggtccaactggagaacctcggccacacagaaccttctgacgtatgttaaatatgccaggcttttcaggcttgtcacaaatgattggtttttctaagtcaccaaatgtatataagttatatatgttggatagcagtcttgcatgcctatcatggaacaatgtaatatgccttcctttcccaccctcaaaaaggccattttatgatgcattgcacaccctctggggaaattgatctttaaattttgagacagtataaggaaaacctggcccg

SEQ ID NO: 2554 - DNA, 1175 bp, Rattus norvegicus
  Genbank Accession No. NM_138847
ctttggtgtacccaggaagtagagataaagtgacttccacttccggctctccagggacgaggatccggagagccaagctagtgggtaaaatgaggcctttgactgaagaagagacccgcgtaatgtttgagaagattgcgaaatacattggagagaatctacaactcctggtggacagaccggacggcacctactgtttccggctgcacaacgaccgagtgtactatgtgagtgagatgatcctgaagctggccgccaacatctccggagataagctagtgtccctgggtacgtgttttggaaagtttaccaagacccacaagttccggttgcacgttacagctctggatttccttgcaccctacgccaagtataaagtgtggataaagcctggagctgagcagtccttcttgtatggaaaccatgtgttgaaatccggtctgggtcggatcactgaaaacacgtctcagtaccagggagtagtggtttattccatggcagacgttcctttgggttttggggtggcagcaaagtctacccaagactgcaggaaagtggaccccatggcaattgtggtgttccatcaagcagacattggggagtacatacgccatgaagagacgttaacttaagatggccatcccaagaacattttgctgtgtgagaagacttagctttgtttcctgtgtgccggccatcatgtttaaatctggataacactgagatatgcagcttggattcttatcaacagaaatggctcaaaaataggtttctggcctctacaaccaaatgcaggtggatcacaaggataaggccactcaggctacttggcaattccaggctagcctgggctacctagtgaggcttgtctcacaaattaaaacagacaaatcagaacctatgagcatttgtgtgagcaaattgagtgtttctattttatgtctgcatcatcgttgattcagaagccttgttctgagtgacggtttctaagttacttcaccgaggacagggataatcttactgttatctgtgataactcttttccaggcttataacagcacagtggactttctaatgtttgttaatattaaagttagaaacagctatataaggacagtaggccatgcctatggttttatatatggagtttaataaattgtaatggttttattttc

SEQ ID NO: 2555 - DNA, 865 bp, Rattus norvegicus
  Genbank Accession No. NM_138861
ggcacgaggctgattcagcagacaaactagggtgtgacttctcagggatgctactgtatttgcctcaaatattttcctcaagggcatcatcgctcctgttcctggtgccctacttgctcttttgggagaatgtagcatctatatccacctgtgcagagagggatgccaccattcagcattccttagagaaacttcttacattgacaacctttatgtctcatgtcatgagtattgaaactgcaaaactcttcactgaatttaataatcagtatgcccagggtaagagatacaatgacaggatccctggaacgtgtcacactgctttttttgatactccagtaaacaaggagcaatctctaggaagtgatccgaaaacactactgaaattggtacgcagtttattgaattcctggaccaatgctctaaatcatcttgtgaatgaaatatctgcaatgcaaggagacccttcttttcttttctccaaagccagagagattcaggcaaaatttgatgaactcatcgacgggtgtaaaacaattctcagcatgattggagagagagataatgacacccaccttgcttggtccgggctgtcatccttgcagtcaagcaatgaagatgttcgctgcttttctttttataccctgattcgctgcctgctccgagactctcgaaaagtaaatacttatcttgaggttatcaagtaccaaatattcaatcaaaacaactgctaatagtaaagcaatataatctgtcttgagatatccctttataaaacattactgcaaagctccctttcgatttctgttaacttctttaaaaataaaagcttcttggaattgttaaaaaaaaaaaaaaaaaaaaa

SEQ ID NO: 2556 - DNA, 1893 bp, Rattus norvegicus
  Genbank Accession No. NM_138877
gggtgtagaacggtgccaccactgtcttcttcgccaccatgggggcccagctgagcacgttgagccgagtggtactctccccggtctggttcgtctacagcctcttcatgaagctgtttcagcgctcctcaccggccatcaccctcgagaaccccgacatcaagtaccctctgcggctcatcgacaaggagattatcagccacgacactcggcgcttccgatttgcactcccttcgccccagcacatcctgggccttcctatcggccagcacatctacctctccaccaggatcgatggcaacttggtcattcgtccctacacccctgtgtctagtgatgatgacaagggctttgtggacttggtggtcaaggtttacttcaaggacacgcatcccaagtttccagctggagggaaaatgtctcagtacctggaaaacatgaatattggagacaccattgaattccggggccccaatgggctactggtctaccagggcaaagggaagttcgccatccgtgcagacaagaagtccaaccctgttgtcaggacggtgaagtctgtaggcatgattgcaggagggacaggcatcaccccaatgctgcaggtgatccgagccgtcttgaaggacccgaacgaccacactgtgtgctatctgctcttcgccaaccagtccgagaaagacatcctgctgcggcctgagctggaggaactgaggaacgaacattcttctcgcttcaagctctggtacacagtggacaaagcccccgatgcctgggactatagccaaggcttcgtgaatgaggagatgatcagggaccatcttccacctcctggggaggagacactgatactgatgtgtggacccccaccgatgatccagtttgcctgtttgccaaacctggagcgtgtgggccatcccaaggagcgatgcttcaccttctgatggctggatgctggccactcccatgcctgctgctcacgcactcaccacaaccaccttccaccccttccttccccactactgtcctttaccctgacatatgcccacatccatgctggggcctgggttcagcctggcctgcccagccctggtcatccagctgtactggcccctgaggggcccctttgggagcaggcctgtgtatcaggtggcttctgttgaccactttctgaataggcttctgtctggtactaactggccattaccagagatggtccatgaccacccctttatacacacacacatacacatacagagacagagagacagagagacagagatagacagagatagacagagagacagatacagacatagagacagacagagacagagagagaggagtcagagagctgttagtaccatgtctacccgttaccatggaccgcaatgtgtagtaaggaaatgaaaggtaaacagttatctacagtcctaggaaccatgcctgtcacctaaccacctactgccttaggctatggcctggtctgtgcccctaaacactacattagacagtgacacccagaggttctcttaggagggtgtctggcagtgacaggccagcccccacttgctggccaggagttccttgggtcagcacgtggacccttccaaaaccccacacactgcccctcccctccatgatgccttgagcaccctaagttgtcagcccaacagagtttggtagaccttggggtacctggcttgtttctccatcccatacctccctcccatctggttcccagcctggggggttctgagcagagcctcttttctcggagacagacccggtgcctggcgctgccttcagcagacagcagacagcctcctgcacactggctttttttagtcatttatgggcaaaatgagttaaaataaaactttgcaaatcctg

SEQ ID NO: 2557 - DNA, 3628 bp, Rattus norvegicus
  Genbank Accession No. NM_138881
tggggatgctagtgcctactgcgctggctgctcggctgctgagcctgttccagcaacagctgggttccctctggagtggcctggccatgctgttctgctggctgagaatagcattggggtggccagatcctggaaagggacagccacgggtccggggtgagcccaaggagactcaggagacccacgaagatccaggcagtgctcagcccacaacccccgttagtgtcaactaccacttcacgcgtcagtgcaactacaaatgtggcttctgcttccacacggccaagacatccttcgtgctgcccctggaggaggccaagcgaggactgcttctgctcaaacaggctggtatggagaagatcaacttttcaggaggagaacccttcctacaggacaggggtgaatacttgggcaagctcgtgagattctgcaaggaggagctagccctgccctctgtgagcatagtgagcaatggcagccttatccgagagagatggttcaaggactatggagactatttggacattcttgctatctcctgtgacagctttgatgagcaggttaatgttctcattggtcgtggccaagggaaaaagaaccatgtggaaaaccttcaaaagctgcggaagtggtgcagggattacaaggtggctttcaagatcaattccgtcattaatcgcttcaacgtggacgaagatatgaatgagcacatcaaggcgctgagccctgtccgctggaaggttttccaatgcctcctgattgagggtgagaactcaggagaagatgccctgagggaagcagaaagatttcttataagcaatgaagaatttgaagcattcttacagcgtcacaaagatgtgtcctgcttggtgcctgaatctaaccagaagatgaaagactcctaccttatcctggatgaatatatgcgctttttgaactgtaccggtggccggaaggacccttccaggtccatcctggatgttggcgtggaggaagcgatcaaattcagtgggtttgatgagaagatgtttctgaagcgcggggggaagtatgtatggagtaaggctgacctgaagctagactggtgaggtgagattggacggagactctaaccagctacgaggagtccacgagcagccgctcgccaccacgcacatctggctgtctacggactgttgctactgagaatgcactctatgttctttctttcagtttgactgaactaagaaaggagtaaaaccattctgtgaacccttatacagccgataagggtcctccacaggggaaggagttcagttcacagaggaacaaggtccagcgatctcaaagaactcacattttatttgtattcgaatttttgtatggatcgttactgtgaatcccatgtttccttttccctttctgttcccccatgagaaactgggttattttctgctaactatgccagttttgtcaacaggaaggatcacaaaacacaccctgcgattactgctgactgttctaatgcttttctgctttggaatctcggactttttgctcagaaatatagaatcaagaagtgtgttatagagccgtacgtgagaaccttactcttttgcaaggagcatatggaaggaggtacttctgaggacggtgtgttcatggcctcagcctctgctgctgctgctgcttcaaggatggctgttctatatcgtaccaattccttcaaggttctggacaaagccaaggtacactttacctttcatggcatggccgtgaagatggcactgacagccgcaaccaccccagcactgaggctgcctgagtctgtcaggctaaaaggttgtcccacttttctgaaaagctacaagggctcttctgcacatccagcagaatcatgacaggatgggcatggaggactcttcaggagtatgaaatgtggctgctgctccttaccatatttctcatgaaactctgaaataagacctagtagtctaggtcaccatgagaaaataatttcttctctacatcaaataagcaaaagagagaacatgaactagcccaaatcttcttcctgtggaagcattgcatgagtttattcaacctagacagcctcactgcttggaaaataattccctggaaattaaataaataccatggaaaagaaattaaactcctctgcaatcccactgtggccactagagggcaccaggaagtcagacttcattgtctcagagacttttcttcagtctttttttagaatttggtgaattttaattctgttccttatctgttttgtctttgttttttgttttggtgcctattactaaaattaatactaaacattttccaaggaactggaattttggccatttacaaaaggtcttcattctttagtgaggtcactataattcaactaagacatactctgtctcattaaaaataggtcaggttttcctgtgttttctgtcttgtttggttgtgtgtgtgtgtttacctatttttgcttgaatatagatataactatgtatcccaggctagcctggaactcatgatacctctgccttaacctccccctcttaagtgcccaggaattacccaactcctgtacagagatttttaagagaagtttgagtcacattcccccctgcagattgtgatttttttttttaagttaagtcctgtgtacatagttcacatgggaaaccatgacatcccagaggacatgggcagacacccacttggtcacacgacagagggaagctgcatgtttctttccctaattaaagtagagcatgaagaaagtatgattggaaagtgagccatcatttacatgtacccccaaccccttgtgcatgcactggcggtgggagatctctgtgcttaaaatattgaaaagtcccctttccttaaagggaaaaattacgatattttactatcgtagtacaaatcaaacttggattagatcatacattggtttgctttttcagtgttaaatktgggtgttcattttgtaaagcatacgctccctgctggggaaacaaggagtgatctagttgacatttgttaagtgtgaccagcagataccttgtgtcccatgattgatttatgcagagcagtaatactgggaagggggatttacttaagaacatcgacgggtaggacatccaacactgatttcaaagttttggcttctttattataatgtgttcggcggtaaaaaaaagtcatgggttgttttctttgaagctgaaagtctcatggtgttatttacctaaattatctgaaaaatttaaaaggggcccaggtttcattctgcgttggagtttgggggtctaattgttgcataaataaacaggcaaccaatcatcagaggttgactcctcccatcaataattcagctcgtgttttacccttttgatggactgatgttgtttcataagctattagtagtccaagaacaatcatgcaggcctcatgtgaatgtgttcagatgaggtttgatgttcgggatacatgtgcatgtatctccctgtagaatgacactgtattttgaggcattgctctagtgtatggaaacgtgatctgtgtattaaaatgttttatgcatgacctcaaaaaaaaaaaaaaaaaaaaaaaaaaaaaaaga

SEQ ID NO: 2558 - DNA, 1743 bp, Rattus norvegicus
  Genbank Accession No. NM_138882
ctccagcccagcgatgtgtcctggcctctgggggacatgcttctggttgtggggatcacttttatggctcagcattggaagatcagggaacgtaccccctaccacccaaccgaagtgcactgacttccagagtgccaacctcctcagaggcaccaacctcaaagtccagtttctcctctttaccccctcggaccccggctgtggacaactagtagaagaggacagtgacatccggaactctgagttcaatgccagtctgggaaccaaactaattattcatggattcagggcattaggaacaaaaccttcttggatcaacaagtttatcagagctctcctgcgggcagcggatgctaatgtgattgcagtggactgggtttatggttccacgggcatgtacttctcagctgtggagaatgtggtcaagttgagcctggagatctcccgtttcctcagcaaacttttggagctgggtgtgtcagagtcctcaatccacatcattggtgtcagtctgggggctcatgttggaggcatggtggggcatttctacaaaggccagttgggacggatcacaggtctggatcctgctggaccagagtacaccagagccagcctggaggaacgcttggattctggagatgccctgtttgtggaagccatccacacagacactgacaatttgggtatccggattcctgtcggacatgtggactactttgtcaatggaggccaagaccagcctggatgccctgcattcattcacgcaggttacagttacttgatctgtgatcacatgagggctgtacatctctatatcagtgccttggagaacacttgcccactgatggcctttccctgtgccagctacaaggccttccttgcaggagactgtctggactgctttaaccctttcctgctctcctgtccgaggattggactggtggaacgaggtggtgtcaagattgagccgctccccaaggaagtgagggtctatctccagactacatccagtgccccatactgtgtgcaccacagcctcgtggagtttaatttgaaggagaagagaaaaaaggataccagcatcgaggtcacctttcttggcaacaatgtaacgtcctcggtcaagatcaccatacctaaagatcaccttgaagggagagggatcatcgcccatcaaaacccacactgccagataaaccaggtgaagctcaagttccacatttctagccgggtttggagaaaagacaggactcccattgttgggactttctgtaccgctcctctgccagtcaatgacagcaagaagacggtctgcatccctgagccagtgcgtctgcaagtgagcatggctgttctccgggacctgaaaatggcctgtgtgtagcctgagcctactcttgaggcagaggccggaatttttcgagggcagtgtggcaagggctgtttgcaagcgccatattctaccctgtttctactaagggggggaaggccaaattcttggtggttttctccataagtagttactgtggaagggacaggtgactcatattacagaacttgatctccgtcaccgacttacaaagctttatacagatgccatttcagcttctctatttcaacacaactgtgattgcctcacagccttaagtatctatacttaggattcaatggaaaatgtactcggagaaatgttttaaataaattgtcatggaatatctgaaaaaaaaaaaaaaagaaaaaaaa

SEQ ID NO: 2559 - DNA, 707 bp, Rattus norvegicus
  Genbank Accession No. NM_138883
aaagatggccgcaccagcaacatccgtgctgtcccgacaggtgcggagtttcagcacatctgtggtcaggcccttttcgaagcttgtaaggccccctgtccaggtctacggcatcgaaggccgctatgcaaccgccctgtactctgctgcgtctaagcagaaaaggctggaccaggtggaaaaggagttgctgcgagtggggcaactcttgaaggaccccaaggtgtcccttgctgttctgaacccctacattaagcgctccatcaaagtgaaaagcctgaaggacatcactacaaaggaaaaattctctccgctgacggccaacctcatgaatttacttgctgaaaatggtcgcctaggcaacacccagggcgtcatctctgccttctccaccatcatgagtgtccaccgtggagaagtgccgtgcacagtgaccacagcgtttcctttagatgaagctgttctctctgagttaaagacagtgctgaatagcttcctgagtaaaggccagatactgaacctggaggtcaagactgacccatcaatcatgggtgggatgattgtccgaattggagagaaatacgttgatatgtctgcaaagagcaagattcagaagctcagcaaggccatgcgggatctgctctgagagactgtcacctgtgtgagcgcttgtctttggagcacaataaaatgcttcctgaacagag

SEQ ID NO: 2560 - DNA, 1115 bp, Rattus norvegicus
  Genbank Accession No. NM_138895
ctgtgagggtgtttcgacgcgctgggcggtttgttccttcatcgcattcgttaacaggtcaaaatgcaaatcttcgtgaagaccctgaccggcaagaccatcaccctagaggtggagcccagtgacaccatcgagaacgtgaaggccaagatccaggataaagagggcatcccccctgaccagcagaggctcatctttgccggcaagcagctggaagatggccgcaccctctctgactacaacatccagaaagagtcaaccctgcacctggtcctccgcctgaggggcggcatgcagatcttcgtgaagaccctgaccggcaagaccatcaccctggaggtggagcccagtgacaccatcgagaacgtgaaggccaagatccaggataaagagggcatcccccctgaccagcagaggctcatctttgccggcaagcagctggaagatggccgcaccctctctgattacaacatccagaaagagtcaaccctgcaccttgtcctccgcctgaggggcggcatgcagatcttcgtgaagaccctgaccggcaagaccatcaccctagaggtggagcccagtgacaccatcgagaacgtgaaggccaagatccaggataaagagggcatcccccctgaccagcagaggctcatctttgccggcaagcagctggaagatggccgcaccctctctgattacaacatccagaaggagtcaaccctgcacctggtcctccgcctgaggggcggcatgcagatcttcgtgaagaccctgaccggcaagaccatcaccctggaggtggagcccagtgacaccatcgagaacgtgaaggccaagatccaggataaagagggcatcccccctgaccagcagaggctcatctttgccggcaagcagctggaagatggccgcaccctctctgattacaacatccagaaagagtcaaccctgcacctggtcctccgcctgaggggtggctattaattcttcagtctgcattcccggcgggcactgatggcattactctgcactctagccatttgccccaatttaagtttagaaattacaagtttcagtaatagctgaacctctgttaaaaatgttaataaaggttttgt

SEQ ID NO: 2561 - DNA, 4590 bp, Rattus norvegicus
  Genbank Accession No. NM_138898
tactcagaggtcccagacacctgcaagactgagggatggagtcatggccaggcgtttccctggtgggactgctgctgctgctactgctgggacaagggccctcccaaatccacggctcttctggagaaaacacatcgcagccccagcaagtgtttcggaccctgaagaatttttcattcccttgcaagccaaagaagttagaactgagtgtgctttctaagtcagttcactctctgagaccctcagacattaaactcgtggcagccatcggcaacctagaaactcctccagcccctggctcaggcgtggtcaacatggagaaacctcaaagcctcgagagcgaactacagaatgtgtgcataggaatcatgacagccctttcagatatcatcagacatttcaacccttctgttctgatgcccacgtgttctcctgggaagggtactgcaggccacactactattgccgaagacttgtggattcaggctaaagagctggtgaggcatctgaaagacaacccggaacttgattttgagaaggactggaaactcatcactgtgctcttcagtaacacaagccagtgccacctgtgttcctctgatcagcagaaaaggcacttgatgaagcacatggagatgctgtcaggggtgctggattacctgcatcgtgaggtccccagagcgtttgtgaatttggtggatctctctgaggttttgaccatggctcagcagcatcaagagactggtttcagccctgcaccagagatttgcaaatgctcagaggaaataacgaagttatccaaggctgtcatgcagtggtcctatcaggaagcctgggaagatctcctggcctccagcaagttcaataagcatgagaccttcgctgtggttttccagtctttcttctctgaggtagaactacccttggagaggccctcgccccaggattccaccacgctcgccctcaggatctggaatagcatgatggaaccagtgggtcgaaaggatgggacactcaatgaagcagagagaaaaacaatgaaatgtccctctcaggagagcccctatctgttcacctacagaaatagcaactaccaggccagacagctgaaacccataggaaagtttcagatgaaagaaggaacaaaattcacctgtcctgacaaagacccctcggactccatccccacaacagttcacaggctgaggccggctgacatcaaggtcatcggagccatgggtgactcgctcacggcaggcaacggggcagggtccagccctgggaatgtcttggatgtcttaactcaataccgaggcctgtcgtggagtgtgggcggagatgagaccatcgagaccgtgaccaccctagccaacatcctccgggaattcaacccctccttgaagggcttctctgttggcactgggaaagaaaacactccccgagcatccttcaaccaggccgtagcaggagccaaatctgatggcttagctgcccaggccaaaaagctggtgagcctgatgaaggatgacaagacaataaactttcaggaagactggaagataatcactgtgtttataggaggcaacgacctctgtggctcctgcaataacctggctcgcttttctccccaaaccttcacagacaacatcaagacggccctggacatcctccatgcagaggttccccgggcctttgtgaacatggtctcggtgattgagatcacccccttgagagaactgttcaatgaacctaaagtcagctgcccacggatgatcctcaggagcctgtgtccttgtgtcttgaaccttggtgagaactcagcagaacttgcccaacttgtggaaaggaacaggcagtatcaggaagaaactggaaaactgattgagagtggccgatacgacaccagggatgacttcaccgtggtcctccagcccatgtttgaaaatgtcgtcatgccacggaccctggagggcttgcccgacagctctttctttgcccctgactgtttccacttcaatgtcaagactcacgctcgctcagccatcgccctctggaagaacatgctagaacctgtgggccgcaagacaagacatcagaattttgaaatcaaggtccctatcatgtgtccaaaccagacctcaccgtttctgagcaccaccaagaacagcaacctgggacatggaacttcgatgtcttgtgaggagaaagccccctctgcctcaccaccaacctcagtgcataccctgagacctgcagacatccaagttgtggcagctctgggagactctgtgactgctggcaatggaatcagctcccaagaaggtgatctcgctgatgttaccacacagtatcgaggactgtcctacagtgctggtggggacaagttcctggagaatgtgaccaccttgcccaacatcctccgggaatttaatggaaatctcacaggctactcagtcggaaccggtgacgtcaactctgcaagcgcgttccttaaccaggctgtccctggggcaaaggctgagaaccttgcaagtcaagtccagactctgattcagaagatgaagaatgacaccagagtgaactttcaccaagactggaaggtcatcactgtgatgattggggccagcgacttgtgtgacttctgcaaggattcgaatcgttactctgcagccaatttttctgaccatctccgcaatgccttggacatcctgcataaggaggtacccagagccctggtcaaccttgtggacttcatgaaccccagtatcattcggcaagtgttcctgaagaacccagacaagtgccctgtgaatcagaccagtgtcctgtgcaactgtgttctgaccccaggggaggattcccatgagctggcaaggttggaggccttcaccaaatcctaccagagtagcatgcttcaactggttgagtcaggccgctacgacacccgggaggatttctctgtggtactgcagccctttctcttcaacatcaggctccccatcctagagaatgggaatccagatacatccttctttgccccagactgcatcctcctaagccagaagttccacactcagctcgcgagagccctttgggccaatatgcttgaacccctgggaaagaaaatggatactttggacccgaaagaactcatagctttggcctgccccaccaaggacaagcccttcctgagaaccttccggaacagtaactacacgtaccctatcaagccagccattgagaattggggcagtgacttcctgtgcacagagcagagtccttccagcaaggtacccacctcagttcatgagctccgaccatcagacatcaaggtggtggcagcaatgggtgactttctgacgacagccaccggagctcgaccaagtgagtccagcagtctagacaccccctggagggggctgtcttggagcattggaggagatggaacgttggagacccataccacactgcccaacatcctgaagaagttcaacccttccatccttggattctccaccggtaccctggagaacacggcaggattaaatgtggcagaagaaggcgccagagctcaggacatgccggcccaggctcaggccctggtgaagaagatgaaaagcacccctacaatcaacatacaggaagactggaagctgattacactcctcatcgggaacaacgacctgtgtctttactgtgaggatccggagaactactcaaccagggagtatgtcaagtacatccagcatgccttggacatcttctatgaggagcttcccagggttttcatcaacgtggtggaagtcatggagctgtccggtctgctccacgaccagggcgggaaatgtgccatgccgttggctgtccagaaaaactgcagttgccttaaacgctctcaaaacctcatggcaatgcaggagctgaagaaagtcaacgggaacctccagagtgccctctcggagctctcctactggcatcggtacatgcagcgtgaggactttgcagtcactgtccagcctttcttccggaatacctttgtcccactggatgagcgtgggggcctcgacctcactttcttctctgaagactgtttccacttctcagtccgtgggcatgctgagatggccattgccctctggaacaacatgctggaaccagtgggcaagaagacaacctccaataacttcacatacaaccggaccaaactcaagtgtccctcgcctgaaaaccctttcctctacactgtccggaacagtcagattcttctagacaaggctaaagaaaactccaatacactctactgggcagtgccagtggctgcagtaggtggcctggtagttggcatccttggaatgatgttgtggagaactgtgagactcgtccaatagaaggaggaggagacttttccaaatacaagtgtggaccttgagttgacccagggatgctgtttcagaggagaagctcagagattgacccttggtaccagacagcaattacgtaatctcagggatggggactgcgtgcctttctctcttgggagttcaccatcttcttttggaaagataaataagaaagagtggctacatcagt

SEQ ID NO: 2562 - DNA, 2908 bp, Rattus norvegicus
  Genbank Accession No. NM_138900
ggaggtatcgaggaagagagaacagggaggtggggcggaggttcctcgcagagcctctggagccgcaggggcttcacggcatgaccagaagcaggagaggaggctgacccacttgttcccatcagctcctgaaggtgacactgagccctgggtggcccctcactgccaaagcagtcacctgtatttgtcagataaagacggccagcccggctgccctttacctccaagtcagagatccagagagccatgggcaaatcgccagagatgtggtgctttgtcttcttttctcttttggcatcgttttctgctgagcctaccatgtatggggagatcctgtcccctaattatccccaggcgtaccccaatgaggtcgtgaaaacttgggacatagaagtcccagaggggtttgggattcacctttacttcacccatctggacatggagctgtcagagaactgtgcatacgactcagtgcagataatctcaggaggtatcgaggaagagagactctgtggccagaggtccagcaagagtcccaactcccccactgtagaagagtttcaattcccatacaataggctccaggtggtctttacgtcagacttctccaacgaggaacggtttactggctttgcagcgtattactcagccgtagatgtaaatgaatgcacagactttacagatgtcccttgcagccacttctgcaataacttcattggtggatacttctgctcctgccccccagaatacttcctccacgatgacatgaggacttgtggggtcaactgtagtggggatgtattcactgccttgattggggagatcgcaagtcccaattatcccaacccatacccggagaactcaaggtgtgaataccagattcggctgcaggagggcttccgactggtgttgactatccggagagaagattttgatgtggaaccagcggactcagaggggaactgccacgacagtttgacttttgctgcaaaaaaccaacagtttggtccttactgtggcaatggattccctggacctctaactattaaaacccagagcaatactcttgatattgtctttcaaactgacctaacggggcaaaataaaggctggaagcttcgttaccatggagatcccatcccctgtcccaaagaaatcagtgctaattctatctgggagcccgaaaaggcaaaatacgtgttcaaagatgtcgtgaagataacctgtgtggatggattcgaagttgtggagggaaatgttggctcaacatcattctattccacttgtcaaagcaacggacagtggagcaattccaggctagagtgtcaacctgtggactgtggtgttccagaacccattgagaatggtaaagttgaagacccagaagacactgtattcggctccgtcatccactacacgtgcgaagagccatattactacatggaacaggaagaaggcggagagtatcactgtgctgctaatgggagctgggtgaatgaccagctgggtgtcgagcttccaaaatgtattccagtctgtggagtacccaccgagccctttaaagtacagcagaggatatttggaggatactctacaaagattcaaagttttccttggcaggtctactttgagtccccccgaggtggcggggctcttatcgatgagtactgggtgctgacggccgctcacgttgtggagggaaactctgacccagtgatgtatgtcgggtccacacttctgaaaatagagcggttgagaaatgcccagaggctcatcactgaacgtgtgattattcatcccagctggaaacaagaggacgacctgaatacacggacaaattttgacaatgacattgccctggtgcagctcaaagaccctgtgaaaatgggacccactgttgcccccatctgcctgccagaaaccttctcagactacaacccctcagaggttgacctggggctgatctctgggtggggccgaacagagattagaaccaatgttattcaactcagaggggcgaagttacccataacatctttagaaaagtgccagcaggtgaaagtggaaaacccgaaagcgaggtcaaacgactatgttttcactgacaacatgatctgtgctggggaaaagggtgtggacagctgtgaaggtgacagcggaggggcttttgctctgccggtccccaatgtcaaggaccccaaattctatgtggctggcctggtgtcctgggggaaaaagtgtgggacctatgggatctacacaaaggtaaagaactacgtggactggatcctgaaaactatgcaggagaatagtgggcccaagaaggactgatccgtagtaacaacacccctccaggactagcaaggtcatttttctcagatcctgggacggtcccattatttcaaaatgatggagagagggtgtgggagcatggttaacgttgaacatgattgtcaagaagcctgcttggaggcagagttgatcactgagccgtgttggttattcagttgctattgctaacaacatgcggaagcctttctgtcttgcttcatcccacagggatatcttaaacgatttccccctcatttaacccgcttgaaatccttattgcttacagtaaagcatgtttccaatctggttctggctgctcgagagcccagaaggagagggaaatttgagggtattttgtcatggaattcaggcatcgacaggttgtctgaaacactatgcagtcagggaacacagccttttttctaagtgagatttacccaatagctggaagtcagaattgactaccttagctttcctttgtgagttgtttcaatatgttccctagaaattagttttcttataatcctcctttgtatcatacaatgtaatgacttaataaaagagaaattgaacattg

SEQ ID NO: 2563 - DNA, 1632 bp, Rattus norvegicus
  Genbank Accession No. NM_138911
atggagcaggtgaatgagctaaaggagaagggcaataaggccctgagtgctgggaacattgatgatgccttacagtgctactctgaggcaattaaactagatcctcagaaccatgtgctctatagcaatcgctctgcagcctatgccaagaaaggagactaccagaaggcgtatgaggacggttgcaagactgttgacctgaagcctgactggggcaagggttattcaagaaaagcagcagcccttgagttcctaaaccggtttgaagaagccaaacgaacctatgaagaaggtttaaaacatgaagccaataatctacagcttaaggaaggcttgcagaacatggaggccaggttggcagagaggaaatttatgaatcctttcaacttgcctaatctgtaccagaagttagagaatgatcccaggacaaggacactgctcagtgaccccacctacagggaactcatagagcaactacagaacaagccttcagacctgggcacgaaactccaagatccccgggtcatgactactctcagtgtcctccttggagttgatctgggcagtatggatgaagaggaagaggcagcaacacccccacctccaccccctcctaaaaaggaggccaagccagaaccaatggaagaagatcttccagagaataagaaacaggctctgaaagaaaaggagctgggaaatgatgcctacaagaagaaagattttgacaaggccctgaagcattatgacaaggccaaggagctggaccctaccaatatgacttacataactaatcaagcagctgtgcactttgagaagggcgactacaacaaatgccgggagctctgtgagaaggccattgaagtaggcagagagaaccgagaggactaccgtcagatcgccaaagcttatgctcgaattggcaattcctatttcaaagaagaaaggtacaaggatgctatccatttctacaacaagtctctggcagagcaccgaaccccagatgtgctcaagaagtgccagcaggcagagaaaattctgaaggaacaagagcgactggcttatatcaaccctgatttggctttggaggaaaagaataagggcaatgagtgcttccagaaaggggactacccccaggccatgaagcactatacagaagccattaaaaggaacccaagagatgccaaactatacagcaaccgagccgcctgctacaccaagctcctggagtttcagctggcactcaaggactgtgaagagtgcatccagctagagccaaccttcatcaagggttatacacggaaagcagctgccctggaagccatgaaggactatacaaaagccatggatgtgtaccagaaggcattagacctggactccagctgtaaggaagcagcagatggttaccaacgctgtatgatggcacagtacaacagacatgatagccctgaggatgtgaaacggcgggccatggctgaccctgaggtacagcagataatgagtgacccagccatgaggctcatcctggagcagatgcaaaaggacccccaagctctgagcgaacacttaaagaatcctgtaatagcacagaagatccagaagctgatggatgtgggtctcatcgcaattcggtga

SEQ ID NO: 2564 - DNA, 357 bp, Rattus norvegicus
  Genbank Accession No. NM_139083
tcttagcgccatcttccttgagactcctgcgccatgagagcgaagtggcggaagaagagaatgcgcaggctgaagcgcaagagaagaaagatgaggcagaggtccaagtaaaccatcttgtgcacccacgaagcctgcgggagcagaagtaagggatgctgaagcccggaacaagtggttggactgtatgctgctgtcggtaataagtctcagtagacccggaatgtcacctcgccgagatcagctgggaaaatgactaccttcctcacaaccaaaacagtcccgctggccctctgccctggacctttggcattctggactagttctgttctcttgtggccaagtgtaactcgtgta

SEQ ID NO: 2565 - DNA, 4794 bp, Rattus norvegicus
  Genbank Accession No. NM_139094
cccgtgggaggaagaggaaggaggagaagggggtggagagtggagggggccgaagcttgagtgtggagtccgcttccgagcggggcggagaaacagagaaggcgccgcgccagcccctcccccaccaccgacccgccccgacggcctcggtcctgctcgctgcgcccgccccgcgaccatgccgggacctcacgggcgctgaggagcgtctccagctagccgtgctccgcggccttctgggcccgtcgcccgcccttccgcacgcaacgcgcccagccgccgcctcttccttcgccgggccccgggcctctgcgcagacaacatggaggccgtgaagaccttcaacagcgagttgtattcgctgaatgactataagccacccatttctaaagcaaaaatgacccagattacaaaggcagccatcaaagctattaagttctataaacatgtggtacagagcgttgagaaattcattcagaaatgtaaaccagaatacaaggtacccggactgtatgttattgactccattgtgcgacaatcccggcatcaggttggtcaagaaaaggatgtgtgtgcacccagatttagtaataacatcattagcactttccagaatttatatcggtgcccgggggatgacaagagtaaaatagtgagagtattaaacttatggcagaagaataatgtttttaagagcgagattatccagcctctcctggatatggcggcagggattcctcccccagttgtcaccccggttttggccagcaccactgtagccatgagcaacactccaggaacacctgtgacacctgttactccagccaatgtggttcaaggcctacctgatccatgggtatcgcagataacaaacacagacacactggcagctgttgcccagatcctacaaagtcctcaaggtcaacagcttcagcaactaatacagaccttacagatacaacagcagaagccccagccctctatccttcaggctttggatgctggccttgtggttcagttgcaggcactcactgcacagcttacagctgcagctgctgcagccaacacacttactcccttggaccagggagtctctttcaacaagaagttgatggatagatttgattttggggaagattctgagcatagtgaagaatccaaaaaggaaattcctactcctcaactctctcacgtttctgagtctgtgaacaactccatcttccatcagatagcagaacagctgcagcagcagaacctggagcagttgcggcagcagctcctggagcagcagcagcctcagaaggtaactcctcaggacagccaggagggagcatttggctctgagcactcagcttcaccctcacaagggagtagccaacagcattttctggaacctgaagcaaatttagatgattccatagacattcagcaacaggatatggatattgatgaagggcaagatgttgttgaagaggagatctttgaaccagaagctaagaaagtagctgttcgctcaagatcaagaactcattcacgatctcgatcaaggtcaccaagaaaacggaggtccaggtcacgctctgggtcccgaaagcgaaagcataggaagaggtctcgctcccgctccagagagagaaagagaaaatcctcacgttcctattcaagtgaacgcagagccagggaaagggagaaagaacgccaaaaaaagggcttgcctcctgtcagatcgaaaacgctaagtgtatgcagcactactctctgggttggccaagtggacaagaaggctacacagcaagatttaaccaacctttttgaggagtttgggcaaatcgaatccattaatatgattccacccaggggctgtgcatatgtctgtatggttcatcgacaagattcatttcgggctctccagaaactgagttcaggatcctataaaattggttccaaggtcattaagattgcctgggctttgaacaaaggtgtaaagacagaatacaaacagttctgggacgtggatcttggagtcacatatataccctgggaaaaagttaaagtagatgacttggatggctttgcagagggaggcatgattgatcaggaaactgtaaatgctgaatgggaaactgtgaaaacctcagaacccgttaaagagactgtccagacgacacagagtccagctgcagttgagaaggagacagtggtcacaacgcagtcagaggttttccctcctcctgtcaccatgctgcagattcctgtagcaccaaccgttcctgcagttagcttagttccaccagcgtttcctgtgtcgatgcctgtcccccctcctggattcagccccatccctccacctccttttctacgagcaagttttaacccttcacaaccacctcctggttttatgccacctccagttcccccacctgtggtacctccccctgcaatcccacccgtagtaccaacatctttagtgcaaccaccattgtctatgaccccagaaactgtgaaagatgttggatttggcagccttgttttaccaggtggttctgttgctggcaatcttgctccttcaactctaccagctggaaatgtttttaatcctcccagtaaagcagagcctgaagaaaaagtacctcaccttacagaacaccagattccttctggtgagaataccagaccagtgattccaagtgatattccaagcagtgctccaatgttagcacagccgcctggggcctcaaacacctctgggatcctgtgcgtgcagagaccaaacgtatcaagcaattctgaaattctgggggttcgtccagccaatgtttccaacagtgctgcgattatgggagcccagccaccaaatatgctcaataactctggaattttgggcatacagccaccaaatgtgtccagtggctctggacttcttggggtactgcctccaaacttgcctaacaactctggacttgtaggactacagccaccaaatgttacaaatcctgctggacttttgggaacacagccaccaattggacctcaaaacttaccccctttaaccatccctgctcaaaggatgcctgcgttgccaatgttagacattcgtccgggactgatagcacaggctcctgggccaagattccctttactacagcctggaattccaccacaacggggtatccctcccccatcggtacttgacgcagctcttcatccaccaccccgtggaccttttcctccaggggatctttttagtcagccagaaagaccttttctggctcctggaagaccaaatatagacagtgttcctaacccagataaaagaataccacttgggaatgacaatatccagcaggaaggggatagagattaccgctttcctcctatagaaaccagggagggcattaatagacctcctccagtggatgttagggatgtggttggacgacctatagatcccagagaaggccctggtaggcctccgttagatggtagggatcattttggaagacctccagtggacatgagagagactcttgtgaggccaggtctagaccaccttggccgaagagaccactttggctttcccccagaaaagccttgggggcctagagatttcgatgagagagagcaccgagttctgcctgtctttggtggtccaaagggcttacatgaagaaagaggcagatttcgggctggaaattatcgatttgatcctagaagtggtccttggaacagaggatttggacaagaagttcacagagattttgatgaccgcagaagaccctgggagaggcagagggatagggatgacagagattttgatttctgcagagaaattaatgggaatcgtcttggacgagatagaattcaaaacacttgggttccccctcctcatgctcgggtttttgattatttcgaaggggccacttctcaacggaaaggtgagaatgtgcctcaagttaatggtggaaatacagagagacatgctccgccaccgcctttgccagtgcagaaggaccctgaactctatgagaagctggcgtcttcaggagacgcagacaaggaggagagcggcacagctgctggtgtagagagtgaagcggtggtagaaagcacagagactgaggggacataacatcgctcagtaggtaaaagaaaccttttgtacagttgtcatctctgtaagaggttaatggctgactgcaccacagttgttcacgtttatctaccagaactaagttaatctgatgtacgtgttcacctttctcttaaaataattgtacaactgacttgtatagacattgttcttaatatgaacatggtaggtaaacatttttttatttttctgataaagtataaatgttgccccagattcttttaacgtcaaggagatgctaacagcttgtcgagacttcctatggaagagaaggttttagacacagtcattgggatgggtatggcaatgacatatttcagaacagcaaggtgtggcacatctccatatctctaggctgctgcagggttttaaggtgacagacaaagctgtgatattttatgcaaggactggctctagattcttgaggagcataatacagagattttaaaaagtgattttgtaaaaatctccactatggtctctgttactccaaagtaagtgtgtgtgatttgttcctcatactgcagtaagtaaaaaagaaaagaagcaaacaacataaacattcaaatacgttttaatgttgggtgaattttgtttttagatgccaataaaacttatttgtttgaaaaaaaaaaaaaaaaaaa

SEQ ID NO: 2566 - DNA, 404 bp, Rattus norvegicus
  Genbank Accession No. NM_139099
ggaattccggggctcaggctactctgaagcgacccagcgttctgcctgacacgccccgctcgagacaccatggtggcgtactggcgacaggctggactcagctacatccggttctcccagatctgtgcaaaagcagtgagggatgccctgaagactgagttcaaagcgaacgctgagaagacttcgggcaccagcataaaaacagtgaaaataaagaaggagtagccgagcctgactgaagcctgacgtgcggagtcttccaggtgaagcatgtgggcacctgttccggcagatggaggtcagccgtacctcctggagacagacacccatcttgttgatgaattgactatgccaataaattaacacggttcactctcggcaaaaaaaaaaaaaaaaaaaaaaaa

SEQ ID NO: 2567 - DNA, 1422 bp, Rattus norvegicus
  Genbank Accession No. NM_139103
gtctccagtgtcacaggcagcttctcaaagtattatgtacttcaaaaaacggagatggtttctgatcctggaatcgcttttgctgtctttggtaactggatttcaagatcaatcagtaccaaatgtaaatgccataaccggcagcaacgtaaccctgacaatcctgaagcacccacttgcatcgtatcaacgtctcacctggcttcatactaccaaccagaagattttagagtacttccctaatggtaaaaaaactgtcttcgagtctgtatttaaagacagggtcgatcttgacaaaacaaatggtgcacttcgtatctataatgtctcgaaagaggacagaggtgactactacatgagaatgttgcacgaaactgaggaccagtggaagataaccatggaagtatacgatcttgtgtccaagcctgccatcaaaatcgagaagactaaaaatttgactgactcctgtcacctgaggctatcatgtaaggtagaggaccaaggtgttgactatacttggtatgaggactcggggccctttccccaaaggaatccaggatatgtactcgaaatcaccatcactccacacaacaagtctacattttacacctgccaagtcagcaatcctgtaagcagcgagaacgacacactgtactttattccaccttgtacgctggccagatcttctggagtccattggattgcagcttggctagtggtcacgttatccatcattcccagcatcctgctagcctgacaagatctctcctcagtcaagaaggaaacatcaaagccgtatcttgccttcatcccctgcactgctcctaaccattgacgctgctctggctccgtggagcaaaggaaagtgtgttattgttatctgtgctggtttgaatgcatgctctatggagtaagcacaggacctagtacagtgctacatcactgatctttacaaagattctaagctaattttttaaaaactgggggtagcatctaattttatataccctagttgtttcctaacattcattgaagataaatgcattccttttaccaaaatatgtggctatcttatactaatgttgtttatatcactctttttttataaagataaatgcattcctttaccaaaatatgtgactatatcatgctaatgttgtttatatcactcctttttgtgaagataaatgcattccttttaccaaaatatgtgactatgtcatgctaatgttgtttatatcactcttttttataaagataaatgcattccttttaccaaaaacatgtggctatattatactaatgttgtttatatcactcttttttataaagataaatgcattccttctaccaaaatatgtgactatatcatgctaatgttgtttatatcacctttttaaaaataaaatcttttcacatact

SEQ ID NO: 2568 - DNA, 1888 bp, Rattus norvegicus
  Genbank Accession No. NM_139104
ctcaggaaggcttcggctgacaggagaggcatgcagacctcaagcagacgctcccttgaagggcaggttgcattcatggttggttcatggaggcggccttggctaggcctgggcggcatcagcctccaacagcagcagcagcagcagcagcagcagcagcagcagcagcagcagcagcagcagcaggagcagcagcagcagcagcagcaaggcgctggccgttccgctcacccacaagaacagctgccaccagtaccctggggatgactagaggccggaccacaggccacaaaaagaagaaggctaccccacttacagatgcagaccatgtgggggtccggagagctgcttgtagcgtggtttctagtactggcagcaggtggtactactgagcatgtctacagacccagccgtagagtgtgtaccgtgggggtttccggaggctccatctcagagacctttgtgcagcgtgtataccagccttacctcaccacttgtgatggacacagagcctgtagcacctaccgaaccatctaccggactgcctaccggattgcctatcgccatagcccggggctgactcccagcaggcctcgctatgcctgctgccctggttggaagaggaccaacgggctccctggagcttgtggagcagggcaacccttccctggatgccgcagggttctgggaactcccctgaatgggtgacagacaggcctctcctacccacagcaatatgccagccaccgtgtgggaatgaagggagttgcatccgcccaggccgctgccgctgccctgtgggatggcagggagatacttgccagatagatgttgatgaatgcagtacaggagaggccaggtgtccccagcgctgtgtcaatactgtgggaagttactggtgccagtgttgggaggggcagagcccatctgcagatggggtgctctgcctgcctaaggaggggccctccccggtggcaccaagtcccacgccaggagtggacagcgtggtgagagagraggtgtacaagctgcaggcccgggttgatgtattagaacagaaactgcagctggtgctggccccactgcacagcctggcctctcggtccccggagcatgggctgcaagatcctggcagcctgctggcccactccttccagcagctggaccggattgactcactgagcgagcaggtctccttcctggaggaacagctggggtcctgctcttgcaaaaaagacctgtgatggcttctcagtgcccatgttggattgagctgttacccctacgtcccttctagcctgagttcaagtgctgtccggtggtgcctgtgagcagaaggccctgcttgtttatccctctctcttaggaggttcctaggccctgggcatggggaggggggtcttgtgtggctcttaagtgaggcttccgggaaaggaataagatctccctgcctaagaagtgaggtggggggctgtctccacctttgtcatattaaagctgggacttgagctgctgtcactgggtgagtcggactgtgtacacactgtactactgccatgtaggagctgcagtgggcagtcctgaggctctcttcagcctatgctgatgctgccaagcccgtggtctgcacacccttcagttctgtggaccctgcattcactgagcaaagcaatgctggctgatcacagctcacctgcaggcagttagggaggagggagctcagacaccgcagccccagggatcgattcacacaccatctttcccacccttcatccctggatggggacttgggaagaactcttaccaccctctggtctctaggcacttctgagttcatttataaaaaaaagacccaaaaaaaaaaaaaaaaaaaaaaaaaaaaaaaaaa

SEQ ID NO: 2569 - DNA, 1664 bp, Rattus norvegicus
  Genbank Accession No. NM_139105
agctagggccatgttttggggctcccgtctgcctttgagagtctttttcgggtcccttcctggccttcttaatacgtggcagagcgtctggaccagaagactacactgtgcaaccaccatgagtcttgacatccagtgtgagcagctgagtgatgcccggtggacagagctccttcccctgatccaacaataccaagtggtcaggctggatgactgtggcctcactgaagtgcggtgcaaagacatcaggtcagcgatccaggccaaccctgccctgacagagctcagcctacgcaccaatgaactgggtgatgctggtgtgggtctggtgctccagggcctgcagaatcccacttgtaagatccagaagctgagccttcagaactgcagcttgacggaagctggctgtggggtcctgcctgatgtgctgcgctctttgtctaccctgcgtgaactacatctcaatgacaaccctctgggggatgaaggcctgaagctgctctgtgaaggactccgggacccccagtgccgtcttgagaagcttcagttggaatactgtaacctcacagctaccagctgcgagcccctggcctcagtgctcagggtgaaacctgactttaaagagctagtattgagcaacaatgacttccatgaggctggtatccacactctgtgccagggcctgaaggattctgcctgtcaactggagtcactcaaactggagaactgtggtatcacatcagccaactgcaaggatctgtgtgatgttgtggcctccaaagcctcactgcaagaactggacttgggcagcaacaagctgggcaacacaggcattgcagcactgtgctcaggactgctgcttcccagctgcaggctgaggactctgtggctctgggactgtgatgtcactgcagaaggctgcaaggacctgtgccgtgtcctcagagccaagcagagcctgaaggaactcagcctagctggcaatgagctgaaggatgagggtgcccaactgctgtgtgagagcctgttagagcctggctgtcagctggagtcactgtgggtaaagacctgtagcctcacagctgcctcttgtccccacttctgctcggtgttgaccaaaaacagttctctgtttgagttgcaaatgagcagcaacccgctgggagactcgggagtcgtggagctttgcaaggccctgggctatccggacacagtgctgcgtgtgctttggctgggagactgtgatgtgacagacagtggctgcagcagccttgccactgtcctgctggccaaccgcagcttgagggaactggacctcagtaacaactgcatgggggacaacggtgtcctacaactgctggagagcctcaaacagcccagctgcatccttcagcagcttgtcctgtatgacatttactggacggatgaggtggaagaccagcttcgggccctggaggaggaaaggccatccctgaggatcatttcctgagatgtacacctctggacacaagatattaatccagccccagaggcagcccaccagatctctggctttggttgtcctagggttggactggcgataagcattgggatcttacttcagtagaaaactttaagacactttataactattaaaatactttgttggcaaaaaaaaaaaaaaa

SEQ ID NO: 2570 - DNA, 4951 bp, Rattus norvegicus
  Genbank Accession No. NM_139110
taaagtctgatctactgaaactctaccctcctcaggctgcctgaatgaatgggacacctttaagtttcacctcacctccgaggtctgcagtgcgctcttctattttaccacacagaagtaaatctgaggaggctgcccagtgctgaagagaaaggcaaagccactcaaacctgaagaaatgaaatcgtcaaggactgtcacgctctactttgtgcttattgtgatttgttcctcagaagctacatggagcaggccagcagagcccattgtccatcctttgattctccaagaacatgaactagcaggggaagagctactgaggccaaaaagagcagttgcagtgggtggtcctgtggcagaagaatacaccgtggatgttgagatcagttttgaaaatgtctccttcctggagtccatcagagctcacttaaacagcctccgttttccagttcaggggaacggcactgacattttgagtatggcaatgactacagtctgcactcctactgggaatgacctcttgtgcttctgcgagaaaggctaccagtggcctgaggaaaggtgtctctcctctctcacttgtcaagagcatgacagcgccctgccaggccgatactgcaattgtctgaaaggacttcctccccaaggacctttctgccagctcccagaaacatacattaccttaaaaatcaaagtcagactgaacataggatttcaagaagacctagagaacacatcctctgccctctataggtcctacaagactgatctggaaagagcgttccgagcgggttacagaactttaccaggattcagatcggtgactgtgacacagttcaccaagggcagcgtggttgtggactacatagtcgaggttgcatcggcaccactgcctggatcaattcataaagccaatgagcaagtcatacagaacctcaaccagacttacaaaatggactacaactccttccaaggaacaccaagcaatgaaacaaagttcactgtgacaccagagttcatctttgaaggagacaatgtaactctggaatgcgaaagtgaattcgtgtcctccaacacatcttggttctatggagaaaaacggtctgacatccagaacagtgacaaattctccattcacacctcaatcatcaacaatataagcctggtcacccgcctcactattttcaacttcacacagcatgatgcaggcttatatggttgcaatgtgacactggatatttttgaatatgggacagtcagaaaattagatgtcactcccatccggattttggccaaggaagagagaaaggtggtgtgtgacaataaccctatatcgttgaactgctgcagcgagaatatcgcgaactggagcagaatcgagtggaaacaggaggggaaaataaacattgaagggaccccagaaacagacctagagtctagctgcagcacttatacactcaaggcagatggaacccagtgtcccagtggttcttctggaacaacagtcatctacacgtgtgagttcgtcagcgtctacggagccaaaggcagtaagaacatagccgtgaccttcacctctgtagccaacctaacaataaccccggacccaatttctgtttctgagggacaaagcttttctataacttgcctcagcgatgtgagtagctttgatgaggtgtactggaacacttccgctggtattaaaatccatccaaggttttataccatgaggaggtatcgggatggagcagagtcggtgctgacggtgaagacctccaccagagagtggaacggaacctaccactgcatatttagatataagaattcatacagcatagccaccaaagatgtcactgttcaccctctgcctctggagtcagacatcatgatggatcctttggaagccagtggtctgtgcaccagttcccatcagttcaagtgctgcatagaagagaacgatggggaagagtacattgtgactttccacgtggattcctcatcctttcctgctgaaagagaagttattggcaagcaggcatgctacacatacagtctcccaggaaagttaccatcacggtgtcccaaagacattgacgtgttctgccactttaccaatgcagccaacagctcagtccggagcccatctatgaagcttacccttgttccagggaagaatatcacatgccaggatcccatcataggtattggggaacctgggaaagtcatccagaagctgtgccagtttgcaggtgtttctagaagccctggacagaccattggtggaaccgtcacttataaatgtgtaggctcccagtggaaggaggagacaagggcctgcatatcagccccaatcaatggtttgctccagttggccaaggctttgatcaagagcccctcccaggatcagaagctccctaaatacctgcgggacctttctgttagcactgggaaggaagaacaggatatacgctcatcgcccgggagcctgggagccatcatcagcatccttgatttgctttcaacagttcccactcaagtgaattcagaaatgatgagggatatacttgctaccattaatgtcatcttagacaagtccaccttgaactcctgggagaagttactacagcaacagagcaaccagagctctcagttcctgcagtcagtggagaggttttccaaagcgctcgagctgggagacagcacccctcccttcctcttccaccctaatgttcagatgaagagcatggtgataaaacgtggccacgcccaaatgtaccaacagaaatttgtcttcacagactctgacctatggggtgatgtagccattgatgagtgtcagctgggaagcttgcagcctgattcatcgatcgttactgtggctttcccaactctcaaagccatcctggcccaggatggacagagaaagacaccctccaacagcctagtaatgaccaccactgtcagccataatatcgtcaagccttttaggatttctatgacattcaagaacaaccatcgttcgggtggcaagccacagtgtgtcttctggaacttcagccttgccaataatacagggggctgggatagcagtgggtgcactgtggaagatgatggtagggacaatagggacagagtcttctgcaagtgtaaccacctgacgtcattctccattctcatgtccccagactccccagacccaggatctcttttaaaaatacttctggatatcatttcttacatcgggttgggcttttccatagtcagcttagctgcctgtctagttgtggaagccatggtgtggaaatcagtgaccaagaaccgaacttcctatatgcgccacatctgcatcgtcaacattgccctttgccttctgattgctgacatctggttcattgtggctggtgctatccacgatgggcattacccactcaacgaaacagcctgtgtggccgccacattcttcattcacttcttctacctcagtgtcttcttctggatgctaactctgggcctcatgctcttctaccggctgattttcattctacatgacgcgagcaagtccacgcagaaagccattgccttttctctaggctatggctgtccactcattatctcatccatcacagtgggggttacacagccacaggaagtttacatgaggaagaatgcatgttggctcaactgggaggacaccagagcactgctggcttttgctatcccagcgttgattattgtggtggtgaacgtgagcatcacagttgtggtcatcaccaagatcctaaggccctccgtcggagacaagccaggcaagcaggaaaagagcagcctattccagatcagcaagagcattggagtcctcacgccactcttggggctcacttggggttttggtctggccacagtgatccaggggagcaatgctgtgttccacatcatatttactctcctcaatgcctttcaggggctcttcattttgctctttggctgcctctgggatcagaaggtacaggaagctttgctgcataagttttcattgtcaaggtggtcttctcaacactcaaagtcaacatccttaggttcatcaacacctgtgttttcgatgagttctccgatatcccgaagatttaataatctttttggtaaaacaggaacatataacgtttccaccccagagacaaccagctcatccgtggaaaattcctctagtgcttactcattgctcaactaggaccagataatgccaaattcacaggagctctcagaaatagggcccctgccaagaaaagggacccatatccaaatctatgggtaaagtgttctctctgcagacttctgggagcagatgctgaagagactctttgaatagagaagatgctttcttttgtaaagacagactaaatgtttaattttgctcccacccctatcccttgtgtaatgccaaatatgtatagtatttaaaagaaccctcccacaaggctcaacctttctctgtgtattgtaaaatagaaaattgagagttttacacacacacacacacacacacacacacacacacacacacacacacaccccattggctacaaagataaaagctgattgaaacagtaagtaaaaagtgagtatccagaatttcagtgaattcaagaaaggaaggagtggggaggggagagaaaggatgatataatggaaggtaggaatgaagggaaggagggaggggtgagataggaaggaaggaaggatgatgtagaaaacgttagggagcacatcaatttccacaattgtgatctaatatggctactcatctaccacagccctgggaatgaaatatatggcttaaaaaaggaaaatgagatgaaaccatggggaatgtaggtaagtttctgatctttccctggctaaaaggataaaagacagaggagggaaagtagaaaagaaagtaggagggaaagat

SEQ ID NO: 2571 - DNA, 1771 bp, Rattus norvegicus
  Genbank Accession No. NM_139253
gcgtcagggggacgcagctggcaaggttcatccacaagtgcttcgcgactgcgtcagggattatcagggtactggaagcatggcatccctgcagctgctcagaggtcccttcctgtgtgttctgctctgggccttttgtgttcctggtgccagggcccaggagcatggggctggtgtccaccatggcagcgtgggcctggacaagagcacagtgcacgaccaagagcacattatggaacatctggaaggtgtcatcaaccagccagaggcggagatgtccccacaggaactacagctccattatttcaaaatgcatgattacgatggcaacagtttgcttgatggcttagagctctcgacggccatcactcacgtgcacaaggaggaggggagtgagcaggtcccacccatgagcgaggacgagctcatcagcatcatagacggtgtcctgagagacgacgacaagaacaatgacggctacatcgactatgcagagtttgccaagtcgctgcagtaggcggcaggccctttcctgtatgcacacgtgacccttgctaatgtgatggacattctggtaatgagaagcagcttatttctgtctactgctgcagcgctggtaaagcctgtggcagtctgttagactggggtaggaggaagccacaaggaatacggagagaagtggggcagtgtcaatgtgtgtttaaacctgttggacaagagctcgaaccttccgaagggtggtggggtatctcaagctcccgggaacctgactctagatgccactctaacttcttgatgttatttcatgctacctgaaaagtaaagacagtctgctttgccaagtggagacttcagtgacggtggagggagagccaaaagccgcgtatcttcccagttgggtcctgctctgggcagatgtggtcagtatgctgttccccaggcatacagcatcacgtcctaaagccacagcaggagaagaatgtcacccacggagtccaccagacacagagtgaagactccttacccactggcattttggaagcgaagcaccactggcctgaatacttagccttttcagatcttcagtttccttcacaactactgccacaccctgtgctctgtcatttcagcccgagagaaaccttgaattgggtgtgctctccgctcaccacccaccgtttgagctccctgaccttgtgttttatccttgctcccagggctcccttcttggcttatgaactattaacttggtatcgcaggtttaaactgtcagctgctctagcctaagtcagaccagaaaagatcagtcattaagggtggtggctaaccttatccaagttttgaaggaatgtttttaaaattacctctttgagcctgaatatgataattcttttaatttcagggaagaacagaaaaggaagagcagtagtagctgaaagagaaacagccataggtcgtactttgcgttgtgaaacgtcatagacttactgtaaacgaatccagaatgatggtgggatcagaaaaagaaactgaatcaaatttgctttacgatgtatagagacttattttctttattaaagtattcttgtaagaaaacttacgtatttgtaaaacagttttctgtgtcaagtatttgtgcaatcggagctgacttgtaaactattcttgtaagatctcattattttgaaagatttatataatgaactctgactatctgacaataaaatggatgaaaaagtaaaaaaaaaaaaaaaaaaaaaaaaaaaaaaaa

SEQ ID NO: 2572 - DNA, 3360 bp, Rattus norvegicus
  Genbank Accession No. NM_139256
gtgacatagatagaagtgataggttttgttggaccagctgaactccattcacgggaactgcaactggtccaacaaaaccttcacttcttttgtcacggtatcatactccaacaagcgcccatcatcagtgccctccatcacggtgcatcgtcatggcggcagcgccgttcttgaagcactggcgcaccacttttgagcgggtggagaagttcgtgtccccgatctacttcaccgactgtaaccttcgcggcaggctcttcggggacagctgcccggtgacactctccagcttcctgacgccggaaaggcttccctatgagaaggcagtgcagcagaacttcagccctgcgcaggtcggcgacagcttcggacccacatggtggacctgctggtttcgggtagaactggtcatccctgaagtttgggtgggcaaggaagttcatctttgctgggaaagtgatggagaaagccttgtctggcgtgatggggaacctgtccagggtttgaccaaggagggtgaaaagactagttatgtcctgagtgagaggctgcacgcagcagatcctcggagcttgactctctatgtggaagtagcctgcaatgggcttctgggagccgggaagggaagcatgatcgcagcccctgaccctgagaagatgttccagctgagccaggctaagctggctgtgttccaccgggatgtccacaatctcctggtggacctggagctgttgctgggtgtggccaagggcctcggggaggacaaccagcgcagcttccaggccctgtacacagccaaccagatggtgaacatatgtgaccctgcgcagcctgagacttacccagcagccgaggccctggcctccaagttctttggccaacgtggaggtgaaagccagcataccatccatgcaacaggacactgtcacattgatacagcctggctttggcccttcaaggagactgtgaggaaatgtgcccggagctggtcaacagctgtgaagctcatggagcggaacactgagttcacctttgcctgctctcaggcacaacagctcgagtgggtaaagaaccaataccctggtctgtatgcccagctccaggagtttgcctgccgaggacagtttgtgcctgtggggggcacctgggtagaaatggatgggaaccttcccagtggagaggccatggtgaggcagttcctacagggccagaacttctttctgcaagagtttggaaagatgtgctctgagttctggctgccagatacatttggctactcagcacagctcccccagatcatgcaaggctgtggcatcaaacgcttcctgacacagaaactgagctggaacttggtcaactccttcccacaccataccttcttctgggaggggctggatggctcccaagtgctggtacacttcccccctggagactcatatggaatgcagggcagtgtggaagaggtgctgaagactgtgaccaacaaccgggacaagggacggaccaaccacagtggcttcctctttggcttcggggatgggggtggtggccccacacagaccatgttggaccgattgaagcggctgggcaacactgatgggcagcccagggtgcagctgtcttctcctggacagctcttcacagcactggagagagactcagggcagctgtgcacatgggttggggaactcttcttggagctgcacaatggcacctatactacccatgcccagctcaagaaggggaaccgagaatgtgagcagattcttcatgacgtggagctgctcagcagccttgccctagcccgaagtgcccagttcctgtacccggcagtccagctgcagcgcctctggaggctcctactcctcaaccagttccatgatgtggtgactggaagctgcattcagctggtggcagaagatgccatgaactactatgaagacatccgttctcatggcaatacgctgctcagtgctgcagccgcagccttgtgtgctggggagccaggtcccaagggcctccgtcattatcaacacactgccctggaagcgcacagaagtgttggcactacccaaggccttgtggggctcacacgcctagccctggtgacagtgcccagtattggctatgctcctgctcccacccctacttcactgcagcccctcctaccccagcagcccgtgtttgtgatgcaggagactgacggttccgtgacgctggacaatggcatcatccgggtgagactggatccaactggctgtcttacttccctggtcctggtggcttctggcagggaagccattgctgagggtgccctggggaatcagtttgtgctgtttgatgatgtgccactgtactgggatgcatgggacgtcatggactaccatctagagacacggaagcctgtgcggggccaggcaggtaccctggcagtaggcgctgaaggtggccttcggggtagtgcctggttcctgctacagatcagccccaacagtcggctcagccaggaagtcgtgctggatgttggttgcccctatgtccgcttccacacggaggtgcactggcacgagacccacaagttcctgaaggtggagttcccagctcgagtacggagcccccaggctacctatgagatccagtttgggcaccttcaggaggccgacccacaacaacactcctgggactgggctcgctatgaggtgtgggctcatcgctggatagatctgtccgagtgtgactttgggctggccctgctcaacaactgcaagtatggaacgtcagtacgaggcaacgtcctcagcctctcactgctgcgtgcacccaaggctccagatgttactgctgacatggggcgccatgaattcacttatgccttgatgccacacaagggttctttccaagaagctggtgttatccaggctgcctacaacctcaactttcccctcttggcactgccagctccaggcccagcccctgataccacctggagcgccttttccgtgtcttcaccagcagtcgtgttggagaccatcaagcaggccgagaagagccatcagcaccgcacactggttctaaggctgtatgaggctcatggcagccatgtggactgctggctacacacatcattgcctgttcaggaggccaccctttgtgacctcctggagcagcgagaccctaccggtcacctgtcccttcaggacaaccgcctgaagctcaccttttctccctttcaagtgaggtccttattgcttgtgcttcagcctccagcaaactgagtctcggctgtggaaagctttgggggctcctcgtctccacctcccaagtctgaagcatcttgtgcaataaatggcttagatcagc

SEQ ID NO: 2573 - DNA, 2362 bp, Rattus norvegicus
  Genbank Accession No. NM_139334
ttttcaggttggaggctggtttttatacagaggtaactcacagggtggatcaccagctgctgctgcagggcaccagtctggcagaagtcccgtcagggatggctgtgggaagacgatgttacatagactgcccggtacacagtcacaccagacacaagcaaggacccacgggcactgagcaggatgggatgggtaggacggcaagtctctggcagccgatgacaaccgcgccttctcaggacactggattaggaaccaagaaaccaagcagtatcgttggatccttcgagaatatctaattctcacatttgccgaggggctagcctcaaacccaccgtgtagctgagattccaggcatgtctcaccatgccgagctttaccgtttgcctctgaaaaccgggccagtaacctttactttctagagctgcctggaggggaaatgccacagagagcaacacttaccaaagtactcaacagagctggcacacagaggtatctaattagtaactcttttttgtttttgtggagctgaggactcaggccttaagtatgctaagtaagcactctaccacagagccccagtcagtcccagccagtgttactaattctgagacagggtcttgttatacatagcctaggctggccttgtacttgctctggagcccaaacgggccttgaccttttgacctattggcctcaaccccctacccagctgggatgacaggccggcacgccctggcttcaataaataattcttaacttctcagataggacttttctctgtccaacatggtggaagccccctctgcagattggttagggcatggctaccttagaagactccttggagcctgtagcccctggagtgcccaggaccccggaatacacagagccaggacagctgatgggggagggagctgcagcccctgggaggtccctgcagatgctgggtacacgctggaggcattggggttaggaccaaagtggttctgcacataacagaggccagaagcaggctggtacggaggtaggctgggcaagtgtccgggaggccaggaggccagtttctgaccactggcatgctgcatctgggtgacagggtgacttcgattccgctccaaggggcctgctgcgagtggaggagctggaggaccagggccagacactggctaatgtgttcatcctgcggctgctggaaaacgcagatgaccgggaggccacctatatgctgaaggcatcctcccagagcgagatgaagcgttggatgacttcactggcccccaacaggaggaccaagtttgtatccttcacatctcggctgttggactgtccgcaggtccagtgtgtccacccctacgtggcccagcagcccgatgagctgacactggaactggcagacatcctgaacatcctagagaagacggaggatgggtggatctttggtgagcggctgcatgaccaggagagaggctggttccccagttccatgacagaggagatcctgaaccccaagatccgctcccaaaacctcaaggaatgtttccgagtgcataagatggaggaccctcagcgcacgcagaataaggaccgcaggaagttgggcagccggaatcgtcaatgaatcccccccagctcaggcaccagcctgaaggagggggtgtgggcagggatgggaagcaggcccagcagagatgcctgacagattcagagggttttagggaagaatgtcagtcgcttcccaggcagcaggagtggcttgggcctgttctgtccctgcccacgcagtggatgttccagcatcctggccactcgcttgcttacacactggcggaaggctaagtacttaggcagtattagaccaccaccctccagcctctcagagggaggagggcaggcattctccagagaccttccggggactggaggagacccacacaagggtccctggcagcagggaggtggaaggtaaccaccgtcaggatcccctgaactgcacgtgtccttccctaccttggaagcagctaagagtctactgggcacaccgatggaccacccctgcccaagggagcttggtgagcagtgctgactctgcctgcccatccccgtgcctctgccagcctcttttgcacggccaagccctgccctcagcaggcctcccagagcttagctgagggttcatgccacctctagctccctgaagggcttgatgtcacgtgtgtctcctggcccctgaaggagcccaggtgttttgcagaatgaattggtcactgcatcctttatggtcatggttttgagaaaagcaaatatcatttttggctgcattaaaagaagcatcctgtatgaaacgaaaaaaaaaaaaaaa

SEQ ID NO: 2574 - DNA, 1030 bp, Rattus norvegicus
  Genbank Accession No. NM_139337
gcggcagggcgtggagcctgggtgcgcacctgggcccccctggccatggccgcgaaggtggacctgagcacctccaccgactggaaggaggccaaatcctttctgaagggcctgagtgacaagcagagggaggaacattacttctgcaaggatttcattaagctgaagaagatccccatgtggaaggagacagcaaaagggctggctgggaaggtggagaaccccaagtataagaaggacaagcagctgaatgagaaaatctccctgttccgtggggacatcaccaagctggaggtggatgccattgtcaatgctgccaacaactccctgcttggaggcggaggggtggacggctgcattcatcgggccgcgggatccctcctgacggacgaatgccgcaccctgcagaactgcgagaccggcaaagccaagatcacttgcggctatcggctgccagctaagcatgtcatccacacggtggggcccatcgctgtgggccaacccactgccagccaggcggctgaactccgcagctgctacttgagcagcctggacctgctgctggagcaccggctgcgatcggtggctttcccatgcatctccacaggcgtgtttggctaccccaatgaggaggctgcggaggtagtgctagctacgctgcgcgaatggctggagcagcacaaggacaaggtggatcggctcatcatctgtgtgttcctggagaaggacgagggcatttaccaggagcgcctgccccattatttcccagtagcctgaggctcccactgcccaccctgaacaggactgacccacctgggcctggaggacctcgttctcagctctgagaggtctcagaagcctgcaacttgttccagcctggccacagcagggttctgccctcaccccgagcctgtcctgccctgcctttaagaagcctcctaataaagctgtctggttcagccctcaaaaaaaaaaaaaaaaaaaaaaaaaaaaaaaaaaaaaaaaaaaaaaaaaaaaaaaaaaaaaaaaa

SEQ ID NO: 2575 - DNA, 2015 bp, Rattus norvegicus
  Genbank Accession No. NM_139342
agagacccaagctgagcctaactggccgaaagagtctccagacttggtcactgttacctgaggaaaagtagctgtcccatgcactgtggctgtcccggccatgtagggagcagcagctggcaaggagtcaggggaatcaagccttagaaagaggaagagtctgccaagggagctgggagagcagccctgccagggctgctgttggctgagggagaggaggagggccatgccatccagacccaacaagaggtcaaagactacaaaattcctaacgacagaaactaagacttcagaaactccaagctgcatcaagttgaggaagtattcaaaccaaaccactgagcgagcatccttccaaacccatgatgtctaaactctcagccgtagacgttgtagacgtcggggttccagctccatctttgcacacataatccaggaagccgctagctctcgatgtcttctgtcaagttatggctcaatggtgcgtcatcgatctctctcgtgggctctgaagaactggagaacctaggatttgtgggcaaaggcgggttcggagccgtgttccgggcacgccacacagcatggaaccttgatgtagcagtcaagatcgtgaactcgaagaagatatccagggaggtgaaggctatggtgaatcttcgtcatgagaacgtgctgctcctgctgggggtcactgagaacctcgagtgggactacgtgtacgggccggctctggtgacaggattcatggagaacggctccctctcagggctgctgcaaccttcatgccctcggccctggcctctcctctgtcgcctgctagaggaagtggtgctggggatgtgctacctacacagcttgaacccttcgctactgcaccgggacctcaagccctccaatgttctgctggatctagagctccacgccaagttagcagactttggcctgtccacatttcagggagggtcacagtcagggtcagggtcaggatcgagagattctgggggcaccctagcttacttggccccagagctgttggataatgacggaaaggcttctaaagcaagtgatgtttacagttttggggtcctcgtgtggacagtgttggctggaagagaagctgaggtggtagacaagacctcactaattcgtggagcagtgtgtaacaggcagaggcgacctccattgacagagctgcctccggacagccctgagactcctggcttagaaggactgaaggagttaatgacgcattgctggagttctgagcctaaagacaggccatccttccaagactgtgaatcaaaaaccaataatgtttacatcctggtacaggacaaggtagatgctgctgtctccaaggtaaagcattatctgtctcagtacagaagcagtgacacaaagttgtctgccagagagtccagccaaaaaggtacagaggtggattgccccagggaaaccatagtttatgaaatgctggaccgcctgcatctggaggagccctctggatcagttcctgaaagactcacaagtcttactgagaggagaggaaaggaagcatcatttgggcatgccacaccagcagggacatcatctgacaccttggctggcactccccaaattccacatactctaccctccagaggcacaacacctaggccagcctttactgagactccaggtcctgacccccaaaggaatcagggagatggaagaaacagcaatccttggtacacctggaacgcaccaaacccaatgacaggcctacagtctattgtcttaaacaactgttctgaagtgcagattggacaacacaactgcatgtcagtacaaccgagaactgcctttcccaagaaggagccagcacagttcggcaggggtaggggctggtagcccgtccacgtccacgagtagacttcggagaggacctgcaagtgcctgaagcaggaaatacaccattcaggcagccagtataaatagagtgaaaataaaagcactttctaagtaaaaaaaaaaaa

SEQ ID NO: 2576 - DNA, 3205 bp, Rattus norvegicus
  Genbank Accession No. NM_144740
gccagtggagggtgctggctttagcacccctggtccctgctctcggcggtctcgcctcgctgcttccgcgtggaagcgtgtgggacttggtgcaatcgcccctcagccatggcggcgcacgggaagttgcggcgggagcggggactgcaacccgagtatgaggcacaggtcaaagtgatgcgcgggcagttgagtgagcagcttcattgcctggagcttcagggagagctgcggcgcgatttgctgctggagctagctgagttcatgcggcgtcgagcagaggtggagctggagtattctcggggcctggacaagttggctgaacgctttactagccgcagtggacgccttggaggcagcagccgggagcagcaaagtttccggaaggagccaactctcctgtcacccttgcactgctgggctatgctgctggaacatactcggcagcagagtcgggaaagtgctaccctcagtgaggtgctggctggacctctggcacagcgcctgagtcacattgccgaggatgtaggacgcattgtcaaaaagagtaaggacctggtgcagcaactgcaggatgagctcctggaggtggtctcagaactccagacacagggctaccttgcctgggcctccctgcagaccaagaagacgtaccatgtataccacttggagagcatgaatgctgagactaaacttcgggaagctgagaggcaagaggagaagcggtcaggcaagagtgccttgcccaccactactgctgcctctgccaccaccaccatcaccattgagacagagctccaccgaaagggctctctcaagaaaggagggcggctagtggagaagcgtcaggccaagttcttggaacataaacttaaatgcaccaaggcccgaaatgagtacctgctcagcctggccagtgtcaatgctgctgtcagcaactactacttacacgatatcttggacctcatggattgctgtgacacaggtttccacttggccctggagcaggccctccgaagctacacagccgctgaaagccgcacccaaacctctcacatgcagggtttaggcagtctggaagaggctctagaggccttggatcctccaggggacaaagccaaagtgcttgaggttcatgccatggccttctgtccccctctacgttttgactaccagccccatgaaggtgatgaggtggctgagatccaggttgagatggaacttcgggatgagattttgcccagagcccaaaacatccaaagtcgcctggaccaaaagaccattgagacagaagaggtgaataagacactgaaggcaacacttcaggctctgctagaggtggtggcatcagaggatggagatatactggactctttgcaggccagcccctccactgagtccctcaagtctacaagctcagacccaggcacccgacaggcaggccgcagacggaaccagcagcaggagacagaaaccttctatattacgaagctgcaggaatatctgagtggccggagcatccttgccaagctgcaggccaagcatgaaaagctccaggaagccatacaacgaggtaacaaggaagagcaagagacatcttcttggacccaatgcacagagagaaaattccataagagccaccacccctatcctggatcccagtgtacccagagactttttggaggtgatctagagaagtttatccagagcacaggccaacctgtgccccttgtggtgaagagctgtatccgcttcattaacctcaatggcctgcaacatgaaggcatcttccgggtatcaggtgcccaggcccggatattggagatccgagatgcctttgaaagaggggaggaccctctggtggaaggctgtactgcccatgacctagactcagtggctggggtactaaagctgtacttccggagcctggagcccccactgttccccttggacatgtttaatgagctgctggcttcagcagaactggaagttgtgggtgagcgggtagagcttgtgagccatctactatccagactacccagacctgtgctagtggtcttgcgatatctcttcaccttcctcaaccacctggcccagtacagcgatgagaacatgatggactcctacaacttggctgtatgttttgggcccacgctgttgcctgtgcctgctgggcaggaccctgtagccttgcagggccgagtgaaccagctggtccagacccttatcctgcaaccagcatgggttttcccacccacagccatgctaccaggtcccatctatgagaagtgcatggccacaccttctgccagctgcctgggggatggccagttggagagccttgctggggagccagagctggaattgaaaactgggaccaaagctcaggaagatgactccgagggagttgtggaggctgtggcctgctttgcttacactggccgcacggcccaggagctgacattccagcaaggggatacgctgagattgtatgctcgggcatcaagtgactggtggcgaggggagcatgctggtgtgcgggggctcattccccataagtacatcacactgtctgagggggatgagaagcagatgactggttcaggattacaggccatgggggaatctctgagccatccagaaagcgtcctgaccttggagtttaccaaccgactggaactaggcaccccacctgaggctttgggcccctctggtcacagacgacactgtttggtccctacctcccctgagcaacatgtggaaatggataaggctgtggcgcagaacatggattctgtgtttaaggagctcttgggaaaggctgctgtccgccagggccatgggctagcatctacagcctcccccagtctaggaactcgaaacctgaagcccctggcctgcagcagcttcagcaaaaacaaagtcttctcccggggacctggggctccagtttccccctcagtttcccatccccagggtccagattcaactcgcaagccagtctgaggcagctcacctccaacagacaccagcaagcccaccattacaccaagcctcaccccagccctgctctaggtctcttgggaggtagcaaaggaaggaggctggagagaagcccttcttgtgcctttgcttggaagctttgggctgtagctgtggaaggtggaagcaacagtaattcataaagacccatgtactgttgtaa

SEQ ID NO: 2577 - DNA, 767 bp, Rattus norvegicus
  Genbank Accession No. NM_144744
atctgattacaccaaaagttccaggactcaggatgctactgttgcaagcgctcctgttcctcttaatcctgcccagtcatgaagggattactgcaaccgaagggccaggagctctggtccctccacccaaggaaacttgtgcaggttggatggcaggcatcccaggatatcctggtcacaatgggataccgggccgtgatggcagagatggcactcctggagagaagggagagaagggagacgcaggtgttcttggtcctaagggtgacccaggagatgctggaatgacaggagcggaagggccacggggctttcccggaacccctggcaggaaaggagagcccggagaagccgcttacatgtatcactcagcattcagcgtagggctggagacccgcgtcactgtccccaatgttcccattcgctttactaagatcttctacaaccaacagaatcattatgacggcagcactggcaaattccactgcaacattccggggctctactatttttcctaccacatcacggtgtacatgaaggatgtgaaagtgagcctcttcaagaaggacaaggccgttctcttcacctacgaccagtatcaggaaaaaaatgtggaccaggcctctggctccatgctcctccatctggaggtgggagaccaagtctggctccaagtgtatggggaaggggacaacaatggactctatgcagataatgtcaatgactctacatttacaggcttccttctctaccatgataccaactga

SEQ ID NO: 2578 - DNA, 1855 bp, Rattus norvegicus
  Genbank Accession No. NM_145084
atgtggatcactgctctgctgctggtcgtgctgctgctggtggtcgttcacagggtttatgtgggccttttcaccggaagttccccgaaccccttcgctgaggatgtcaagcggccacctgaacccctagtgaccgacaaggaggctaggaagaaagttctcaaacaagctttctcagtcagccgagtaccagagaagctggacgcagtggtgattggcagcggcattgggggactggcctcagctgcggttctagctaaagctggcaagagagtccttgtgctggaacaacacaccaaggcaggcggctgttgtcatacctttggggaaaatggccttgaatttgacactggaattcattatattggacgaatgcgggagggcaacattggccgtttcatcttggaccagatcaccgaagggcaactggactgggcccctatggcctccccttttgacttgatgatactagaaggacccaatggccgaaaggagttccccatgtacagtgggaggaaagaatacatccagggccttaaggagaagttccccaaggaagaggctgtcattgacaaatacatggagctggttaaggtggtggcccatggagtctctcatgccatcctactgaagttcctcccattgcccttgactcagctcctcaacaagtttgggctgctgactcgtttttctccattctgccgagcgtctactcagagcctagctgaagtcctgaaacagcttggggcttcccctgagctccaggctgttcttagctacattttacccacttacggagtaacccccagccataccaccttttccttgcacgctctgctggttgaccactacatacaaggggcatattacccccgacggggctccagtgagattgctttccataccatccctttgattcagcgggccgggggcgctgtcctcaccagggccaccgtacagagtgtgctgctggactcagctgggagagcgtgcggtgtcagtgtgaagaagggacaagagctggtgaacatctactgcccagttgtcatctccaatgcgggaatgttcaatacctatcagcacctgttgccagagtctgtccgctacctgccagatgtgaagaagcagctgacaatggtaaagcctggtttgagcatgctgtcaattttcatctgtctgaagggcaccaaggaggagctcaagcttcagtccaccaactactatgtttattttgacacagacatggacaaagcgatggagtgctatgtctctatgcccaaggaaaaggctccagaacacattccccttctcttcattcccttcccatcaagcaaggatccaacctgggaggaccgattcccagaccgatccacaatgactgtcctggtacccacggcctttgaatggttcgaggagtggcaggaggagcctaagggcaagcgaggtgttgactatgagaccctcaaaaataccttccgggaagcctctatgtcggtgatcatgaaactgttcccacagctggaaggcaaggtggagagtgtgactggaggatccccactgaccaaccagtactatctggctgcacaccgaggagctacttatggggctgaccatgacctggctcgtctgcatcctcatgcaatggcttccctaagagcccaaacccccatccccaacctctacctgacaggccaagatatcttcacctgtgggctgatgggggccctgcaaggggccctgctgtgcagcagtgccatcctgaaacggaacctgtactcagatctgcaggctcttggctcaaaggtcagggcacaaaagaagaagaagtagtctattcagagatgagctagaggaa

SEQ ID NO: 2579 - DNA, 1750 bp, Rattus norvegicus
  Genbank Accession No. NM_145091
tggtgaggagaggacgaggatactagaatgtcaagtactgcgtcctaccggatcttcaattttgcaaggaatcgtattgctgtattacgagggggtagacgcttgtactccagggcagccacgagtaggaatcaagtgaaatggaggctcttttctcccgcatcattggccgtgaacgacagttctccacatggtggctttgctctgcggaaagcttacagacacacatcaaccgaggaagaggatttccacttgcagctcagccccgaacaggtcagtgacctgctccgagctggcgagtcatcccacaaggttctggatttcaacagcggagttccaaattcagtgttaaggtttgagagcaaccagttggcggccaattccccagtggaagaccgacaaggtgtggcttcctgcgtgcagacgagggggacggtgtttggtatttttgatgggcatggtggccatgcgtgtgcacaggcggtgagcgagaggcttttctattacatggcggtgtccctcatgtcccataagaccttggagcagatggaggaagccatggagaacatgaagcctttgctgcccatcctgcagtggctcaagcaccccggagacagtatttataaagatatcacatcggttcatctggaccacctccgagtctattggcaggaactccttgacctacatatggaaacgggactaagcactgaagaggcattgatgtactccttccagagactggactccgacatctcgctagaaattcaggctcctctggaagatgaggtaacgaagaacttatccctccaggttgctttttctggggcgacagcctgcatggcccacgtcgacggagttcacctgcacatagcaaatgctggcgactgccgagctatcctgggtgtccagggagacaatggagcgtggtcatgtttacctcttacctgtgaccacaatgcctggaatgaggcagagctgtcccggcttaagagagaacaccccgagtctgaggacaggacactcatcatagatgacaggctgctgggtgtcctcctaccctgcagggccttcggggacgtccagctaaaatggagtaaagagttgcagcggaacgtcctagagaggggatttgataccgaggccctcaacatctaccagtttaccccgccccactaccacactccaccctacctgactgctaagcctgaggtcacataccacaggcttaggccccaagataagttcctcgtgctggcctcagatggcctctgggacatgctggacaatgaggatgtggtaaggctggtggtggggcacctgtccaaggtcggtcaccagaagccagccctggatcaaagaccagccaacctgggccacatgcagagtctgctgctgcagaggaaagccagcggactccatgcagctgaccagaatgcagccacacatctgatcagacatgccatcgggagcaacgagtatggggaaatggagccagagcgtctggctgccatgttgacgctgccagaggatgtggccaggatgtaccgggatgacatcactgtcatggtggtgttttttaactcagaatcaattgatacctattttaaggagggttaagagtctcaccctgttgccaaggctaactcgaatgccctttatttagaacatttccactcattccttagtgagcaatccaaaccttagtaaagaacaggcagacataggttgctgagtaattccggaattc

SEQ ID NO: 2580 - DNA, 2310 bp, Rattus norvegicus
  Genbank Accession No. NM_145092
tagaatcgaaccgcggaaagtccatcgtccctatcgaccaacagctacgtaaacaactatggcgggagagaggtggcgggccgaggggctgggagaaggatgggccatctacgtcacacccagagcccccatccgggagggaaggcggaggctcgccactcaaaatggcgacgggagtgacgcgcctgcgtacgaaactcatccgtcgcgccacggacgacgggaagtgaggttttcagaagagccgccagaagtgtacggcgacttcgagccccgggcggccaaagaaaggtctccgggggaaagacgaaccccgccagaaaagttccggtcggattctgcgaaagaggaagtgagagaaagcgcttacaatcttcggtctcgacaacggaggcagcggggaccccaggaagccgaggagatgaagacgcggaggtctactcgtctggagcagcactcacagcaggcgcagcagcagctgtcaccggctacgagcgggcgaggattacgggacgctcagtccttaagtgaggaccgcggagaggatgaaccttcttcccaacctgttacaagccaaacagtctcaaagaaaactgtcaggacaccagagacttcagtgatgagtgaagatcctatcagtaacttatgcagacccccattaagaagcccaagacctgacgcttccattgtccaacacatcaacccctttgaggaagatgaagccgcagtagcagccggtcaccatccagactcactgtgggggttaccacacagtcggggggacttcacagctcatgagaatcaaccctcactgctgcccacaggatgtcaaaaaaaccctcaagagtgggttgaacaagctgtgagaatgaggactagaatggcatataacaacattcagaaatcagactttggaaaccaatctccatcaacctccaggcaacaagcagctgtacaacccccagatgagtcttctgtcaagataaaatggtggctgctgatacttgttgctgctctggccatgggaatatattggttctttcatactcctgtagtagaaatcactgcagctcaggatgctgcggaagtgctcaagtgtctgagtgaacagatcgccgatgcctactcttccttccgcagtgtccgtgccatccggatcgacggagcaggcaaagctgctcaagacagtgacctcgttaagcacgaagtcgatcaggaactgacagatggatttagaaatggccagaatgcagctgtggtccaccgcttcgaatccctgcctgcaggctcaaccttgatcttctataaatactgtgaccatgaaaacgcagccttcaaagatgtggccctcgtcttgacggtactgttggaggagcagacgctggaagccagtctaggcctaaaggaaattgaggagaaagtgagggatttccttaaagtcaagttcaccagctctgacacggccaactcctacaaccacatggacccagacaagctcaatggactctggagccgcatctcccacctcgtgctgcccgtgcagcctgagaatgctctgaaagcaggcagctgcttatgagggaaagaagcggaaatcctgtctcgagtttgaaccattttcagactttgtaaccagagacggattttggagcagtttttgaaaactggtttctttttaaaggaagtaaagttcatacataaaggtggaataactaaatcatttatgcagcctacttctctgtgatttgggagaatcgtttttctatttccacctagaaccatgttaaagatatttagcatagtgcacagtatatgcagtccccgagtgtctgctaccttgattctggccgaatcattcttgctgtgtgaccagcgagaagggctaggttcctctctcaagcaatcagctttctattgaattttggatttgtgtttgtgaccttattaatgtctgacaaccccctaattgtagctatggatttccctgttacttcttctctcataccattgaaatgtgtggtccttagtttctacctataaaaataaaactgggtgtgcagtttagccagcccctcccccactggtttgtagagagggagacaagggtgtgggaggtagaaagagaagagaaattgtttaatagggaagggaaggaaggaaggtaaaaagatgttgcaagctgggcatggtaagccagcctgttatcccagtattgtcccagtagtcaggaggagcagaggttcaaggtcagcctcatctatagagtgagttttctgccacctggactacatgagacactgtcttaaaaac

SEQ ID NO: 2581 - DNA, 1487 bp, Rattus norvegicus
  Genbank Accession No. NM_145096
cacgagcggcggagcagcgggagtccgcggcgcccgctcgccgccgcgggatggggagctagcgccacggcggccgcggtggccgcagcacagccggccgccgcccccgggcctgtcccgccgggtgctccgggagccccgagcccggccccgagccaggcccgcgggcggcggcggcggaggagctgggcaggtgtatgcggctggaagatggcgccctcgggccccggtggcgtgaggcggcggtgccggcgggtgctctactggatccctgtggtgttcatcagcttgcttctgggctggtcctactatgcttacgcgatccagctgtgcatagtgtccatggaaaacattggtgaacaagttgtgtgcctcatggcttatcatctacttttcgcaatgtttgtctggtcatactggaaaaccatttttacattgcccatgaatccttcaaaagaattccatctctcttatgcagagaaagaattgctggagagagagccaagaggagaagcccatcaggaagttctgaggcgagcagccaaagaccttcccatctacaccaggaccatgtccggcgcgatccgatattgtgacagatgccgacttataaagccagaccgctgccatcactgttccgtctgtgataaatgtattttgaagatggaccatcattgcccatgggtgaacaattgtgttggattttcaaattataaattcttcctccttttcttggcttactctctgctgtactgccttttcattgctgctacagatttacagtattttatcagattttggacaaatggtctccctgatactcaagccaagttccatattatgtttttattctttgctgcagctatgttttctgtcagcttgtcctctctttttggttatcattgctggctagtcagcaaaaataaatctacattagaggcattcagaaatccagtatttagacatggaacagataagaacggattcagcttgggtttcagtaaaaacatgcgacaagtttttggcgatgagaagaagtattggctgttaccaatattttcaagtcaaggtgatggctgttcctttccaacttgccttgttaaccaggatcctgaacaaccttccactcctgcaggactaaattcaacagcgaaaaatcctgaaaaccatcagtttcctgcaaagccgttgagagagtcacagagccacctccttacggattctcagacctggacagagaacagttcaaactccgggagatgcaaagccggtatgagcaaccctgcattaactatggagaacgagacttaactctacaatcaaaataaaaccactcttgtaaagtaccaaggctgtggaagactggaacaagcttccaattggatggcaccattggccaattgtccctttggctaaatatgcgaattttgtcttcagtgatggggatcaaacacagcactatcaagaatttcaagtaatcaccaaac

SEQ ID NO: 2582 - DNA, 3150 bp, Rattus norvegicus
  Genbank Accession No. NM_145677
ggcatatcttgtgctagtttcccaggaacccggcattccctactcttgacttctgccggcacttgctcctggtggtagctgagcaccgggtctcaccagcatgctctgcctgtgcctgtatgtgcccatcgctggagaggctcagactgaattccaatactttgagtccaaggggcttcccaccgagctgaaatccatcttcaaactcagtgtctttatcccctctcaggagttctccacataccgccaatggaagcagaaaattgtgcaagcaggtgacaaggaccttgatgggcaactggacttcgaagagtttgtacattacctccaagaccatgagaaaaaactgaggctggtgtttaagagtctggacaaaaagaatgatgggcgaatcgatgctcaggagatcatgcagtccctgcgggatctgggtgtcaagatctctgaacagcaggcggagaagattcttaagagcatggataagaatgggacaatgaccatcgactggaacgagtggagggactaccacctcctgcaccctgtggagaacatccctgagatcatcctgtactggaagcactcgacgatcttcgatgttggtgagaatctgacagtcccagatgagttcacagtggaggagaggcagacagggatgtggtggaggcacctggtggcaggaggtggtgcaggggcagtttccagaacctgcactgcccccctggacagactgaaggtgctcatgcaggtccatgcctcccgcagcaacaacatgtgcatcataggtggattcacacagatgattcgagaagggggcgccaagtccctctggaggggcaatggcatcaatgtcctcaaaattgcccctgagtcagccatcaagttcatggcatatgagcagatgaaacgccttgttggtagtgatcaggagacgctgaggatccacgaaaggctagtggcaggctccttggctggggccattgcccagagtagcatctacccaatggaggttctgaagacccgaatggccctgcggaaaacaggccagtactcgggaatgctggactgtgccaagaggatcctggctaaagagggtgtggctgccttctataaaggctacatccccaacatgctggggatcatcccgtatgcgggcatcgatctagctgtctatgagacattgaaaaatacctggctacagcgctatgctgtaaacagtgcagaccctggcgtgtttgttctcctggcctgtggcacaatctccagtacctgtggccaactggccagctacccactagccctggtcaggactcggatgcaggcacaagcctccattgagggtgcacctgaggtaaccatgagcagcctcttcaaacagattctgcggactgagggggcctttgggctctaccgggggctggcccccaacttcatgaaggtgattccagctgtgagcatcagctacgtggtctacgagaacctgaagatcaccctgggcgtgcagtctcggtgacgggagggtggcggacttggtgaccctgggctgcagcccagggtgtgcagccgcctcattctgtgaatgtgccaacactaagctgacttacccaagctgtgaaacccaggatgctgcaggggacgggcagggagctgcaagcgctgggctggtcctgctgacctggcagacctttgtgtctcttccaaggaagacctgtggacattccttggggtccaggggtcagtaagatgtgggctcctgcacctagagacaggacgttttccacagtgcctgccaggtagcgagcttggatgccagcttagctcttccatctcgtcacgcaacctgacctcagccatggcatccctctggtccaaagagcattcctgtgcccctcatctcttcccactgatgcgctggggtaggaagtgggcccacccccactcttatccttctgtccatcttccctcagtgctgctcttccaaacctggttcccaagctgtagcatccatgaggactgtggtacgggaagctggagaagtaccattatgtcctcgctcgcctattctgagctcaccagcaaggccacctggatgcgcccaggtcctcaggcaccggctgcctgacaccatggtgcatggctttgctaaaagctagtgctagaacctggaacccagaggatttgtgctgcctgcatgggcctaatgtcctctgagctgcccctaaaccctgtcaggactggcaccagctcgtgcccacactcatggtggttctgtggtgagagggtgggcagggtgtctgctccaggtctgctgctctggtgagaagatgctgaaggccttaattatgtcttactgggtaaaggatttggttcagaaggacaagctggacactgcacgtgccacactttcagagagcctgggggaaagtgtgttctgagggccctgtggggccaagggggaccagcctcacattccacacgtgtgccactctgcttggagcctatttattttgtatttatttgaacagagttatgtcctaactatttttatagatttgtttaattaatagcctgtcattttcaagttcattttttttattcatatttatgttcatggttgattgtaccttcctgtcaccagctggtggggcatggggagacaaggtagaaaagtggccacagagtgaccttacctgctgcccacactgacggcatgtccgtctcacaggaaacagaaggaaaggcacagggaggactcttcaggccaggtagggtagtgggaaaggtggcgacttcttgacattctttcctggaccgggaggttttctttattttgcccttttggaaaacacggcagtgaggtgcttcattcaccaggaatttggtgtgagggtgaggactgaagggcctgccttccccaacctgtgacctggtctcgctcctggcccgagactgcccatgctcaatgagtggccagctggccacttggcaatcatgcctccattgccccagaatggcctgatgaggaaaatccaaataggatgcaaagatcaatgcaaaagtcaccagtctgcatagtctgtgctgtaactggagtttgtcaaagacgagcaaccttctaataaagtcgcttcaaatgtgaaaaaaaaaaaaaaa

SEQ ID NO: 2583 - DNA, 989 bp, Rattus norvegicus
  Genbank Accession No. NM_145773
aggcattgaaacaaaagtggtaacgcggctgccagggccagcatccctatcccgctcgccgtcgctgtcgccgacatggaacccgtggctagcaacatccaggtcctgctgcaggcagcggagttcctggagaggcgcgagagagaggcggagcacggttatgcgtccctgtgtccacaccacagtcccgggaccgtatgcaggaggaggaaggcacccctgcaagctcctggcgcgctcaacagtgggcggcatgtgcacaatgagctggagaaacggaggagagcccagctgaagcggtgcttagagcaactgaggcagcagatgcccttgggagttgaccatacccgatatactacactgagcctgctgcgcggagccaggatgcacatccagaagctggaggagcaggagcagcaggcccagcggctcaaggagaagcttcggagcagacagcagagcctgcagcagcagttggagcagctccaggggctgctgggagtgagagagcgggaccggctgagagctgacagcctcgattcttcaggcctgtcctctgagcgctttgactcggaccaagaggatctggaggtggatgtggaaagcctggtgtttgggactgagacggagctcctacagagcttcagcgctgggcaggagcacagctactcacacagcactggcacctggctatgatgcccgccgccggagtggcctgtactctctctggactgaacccgccagtcagtggctcacagccacgtgtcgaagtgacaataaagccatcaccgtgtgggagcagattctggactctgctgcacagcttgagcctgggctaccctccccacccccaggggattttatgtagcgcttggctctgctctgctgctcccacagggaccagaggcctgtaaacttcttgttcctgcaaagccccagcctctgcccatatataccgcacagtattttcattaaaatcctctttcata

SEQ ID NO: 2584 - DNA, 2297 bp, Rattus norvegicus
  Genbank Accession No. NM_145775
agacctgaaaggggaatttcctaaatctccaggctggacagtttgtttctccctctcacctcctataactcatctgagtcttatctccatatcacatttctaagtctcttgtactcagagtcattgtgactcttgggaggccagagccaggctgaacagagtccttccctgcagtactctatgagaatatgtctttgggtttgaaagaaaggtggtgttatcacctacattggctccagcggatcctcccccagccggaccagcccagagtccctctatagtgacagctccaatggcagcttccagtccctgactcaaggttgtcccacatacttcccaccatcacctactggctccctcacccaggaccctgcccgctcatttggcactgtgccacccagcctcagtgatgatagctccccttcttctgcttcatcatcatcatcatcttcctcctcctccttctataatgggagcccccccggaagtctacaagtggccatggaagacagcagccgagtgtcccccagcaagggcaccagcaacattaccaagcttaacggcatggtgctactgtgtaaagtgtgtggggacgtggcctcaggcttccactatggcgtgcatgcctgcgagggctgcaagggctttttccgccggagcatccagcagaacatccagtacaagcggtgtttgaaaaacgagaactgctccattgtccgtatcaatcgcaaccgctgccagcagtgtcgcttcaagaagtgtctctccgttggcatgtctagagacgctgtgcgttttggacgtatccccaagagagagaagcaacgaatgcttgctgagatgcagaacgccatgaacttggccaacaaccaactgagcagcctgtgccctctagagacctcacctgccccgcaccccacctcaggctccgtgggcccctcaccacctcctgcaccagccccgacacctttggtgggcttctctcagttcccacaacagctgacaccacccagatccccgagtcctgagcccacggtggaggatgtgatatcccaggtggccagggcccatcgagaaatcttcacctatgcccatgacaaattaggcacctcacctggcaacttcaatgccaatcatgcatcaggtagccctccggctaccactccacagtgctgggagagtcagggatgcccgtctacccccaacgacaacaaccttttggcggctcagcgtcataatgaagcactgaatggtctacgccagggcccctcctcctaccctcctacctggccttctggccctgcccaccacagctgccaccagcctaacagcaatgggcatcgcctgtgccccacccacgtatactcggccccagaaggcaaggcacctgccaacggtctacggcaaggcaacaccaagaatgttctgctggcatgtcccatgaacatgtatccccatggacgtagtggccggactgtgcaggagatctgggaagacttctctatgagcttcacacccgctgtgcgggaggtggtagaatttgccaaacagatccccggcttccgtgacctttctcagcacgaccaggtgaccctgcttaaggctggcacctttgaggtgctgatggtgcgctttgcgtcattgttcaacgtgaaggaccagacagtcatgttcctgagccgcacaacctacagcctgcaggagctcggtgccatgggcatgggtgacctgctcaatgccatgtttgacttcagcgagaagctcaactctctggcgcttactgaggaggagctgggccttttcacggcagtggtacttgtctctgcagagggctcgggaatggagaattccgcttcggtggagcagctccaggagacgctgctgggggctcttcgggctctcgtgctgaagaaccggccctcggagacttcccgcttcaccaaactgctgctcaagctgccggacctgcggaccctgaacaacatgcattccgagaagctgctgtccttccgggtggacgcccagtgacccgcccggccggccttctgccgctgcccccttgtacagaatcgaactctggacttctctctcctttacgagacgaaaaggaaaaccaaaccagaatcttatttatattgttataaaatattccaagatgagcctctggccccctgagccttcttgtaaataactcttcccccccacccccatgctcccttcctcccgtatttaaaccactcttgctctcccaccctcctctggcccctcgatttgttctgttcctgtctcaaatccaa

SEQ ID NO: 2585 - DNA, 1420 bp, Rattus norvegicus
  Genbank Accession No. NM_145778
ccggaattcgccatggcgatgccgagagaaatcatcaccctacagttgggccagtgcggcaatcagattgggttcgagttctggaaacagctatgtgctgagcatggcatcagccccgagggcatcgtagaggagttcgccaccgagggcactgaccgcaaggacgtctttttctaccaggcagacgatgagcattacatcccccgggctgtgctgctggacctggagccccgggtgatccattccatcctcaactcctcctatgccaagctctacaacccagagaacatctacctgtccgagcatggaggaggggctggcaacaactgggccagcggattctcccagggagaaaaaatccacgaggacatttttgacatcattgatcgggaggcagatggcagtgacagcctagagggatttgtactgtgtcactccattgctggggggacaggctctggcttgggctcctacctcttggaacggctaaatgacaggtaccccaaaaaactagtgcagacgtactccgtgttccccaaccaggacgagatgagtgacgtggtggtccagccctacaactccctcctcacgttaaagaggctgacccagaacgcggactgtgtggtggtgctggacaacacggccctgaacctgatcgccacagaccgcctgcacatccagaacccatccttctcccagatcaaccagctggtgtccaccatcatgtcagccagcaccaccaccctgcgctaccccggatacatgaacaacgacctcatcggcctcatcgcctcactcattcccacccctcgactacacttcctcatgactggctatacccccctcaccacggaccagtcagtggccagtgtgaggaagacaacagtcctggatgtcatgaggagactgctacagcccaagaacgtgatggtgtccacaggtcgggatcgtcagaccaaccactgctacatcgccatcctcaacatcatccagggagaggtggaccccacccaggtccacaagagcctgcagaggatccgggagaggaagttggccaactttatcccctggggcccggccagcatccaggtggccctgtcaaggaagtctccatacctgccctcagcccaccgggtcagcgggctcatgatggccaaccacaccagtatctcctcgctttttgaaaggacctgtcgccagtttgacaagctgaggaaacgggaggccttcatggagcagttccgcaaggaggacatcttcaaggacaattttgacgagatggacacctccagggagattgtgcagcagctgattgacgagtaccatgcggccacacggccagactacatctcctggggcacccaggagcaatgagtcgcccgagacagggaccctcatctgccttaccggttagccatgg

SEQ ID NO: 2586 - DNA, 2451 bp, Rattus norvegicus
  Genbank Accession No. NM_145784
ggcacgagtggaggcggacccagctgccagctgcctctcttaattccacacagtccttaggtccctcgccctcacctctctgaggcagctgtgccctgctttcctggccatgcggtggctgtggcccctggctgtctctcttgctgtcgtgttggctgtggggccgagtgaggtctctggggctgccaccttatctttgggtggtcatagagccaaggtccaggagcagcagagtcgaccccgaagaggtaccaaggatgaggggcccaaggaggtacagcactatgtacctgaggagtgggctgagtaccccaagcccatccaccctgctggcctgcagcccaccaagcctttggtggccactagccccaacccagacaaggatggggccacctcagagagtggacaagagctgaggaccaacctgaccgggacaccaagtcagaggctgcagattcagaaccccctgtatccggtgaccgagagctcctatagtgcctatgccgtcatgctcctggctctggtggtatttgctgtgggtatcgtgggcaatctgtctgtcatgtgcattgtgtggcacagctactacttgaagagtgcctggaactctatccttgccagcctggctctctgggatttcctggtcctcttcttctgcctaccaattgtcatcttcaatgagatcaccaagcagaggctacttggggatgtttcttgccgagcagtgcccttcatggaggtctcctccctgggagtcacaaccttcagtctctgtgccctgggcatagaccgattccatgtggccaccagcaccctgccaaaggtgagacccattgagagatgccaatcaatcctggctaaactggctgtcatctgggtgggctccatgatgctggctgtgcctgaactcctgctgtggcagctggcacaagagcccactcccaccatgggaactgtggactcatgtatcatgaaaccttcagctgacctgcccgaatccctctattcgctggtgatgacctaccagaatgcccgcatgtggtggtattttggttgctacttctgtctgcccatcctcttcaccgtcacctgtcagctggtgacatggcgggtgcggggcccaccgggcaggaagcctgagtgtagagcgggcagacatgagcagtgtgagagtcagcttaacagcaccgtggtgggcctgactgtggtctatgccttctgtacgctccctgaaaacatctgcaacatcgtggtggcttacctctccactgagctcacgaggcagaccctggacctcctgggcctcatcaaccagttctccacgttcttcaagggcgccatcactcccgtgctcctcctgtgcatctgcaggccgctaggccaggccttcctggattgctgctgctgttgctgctgtgaagaatgtggtggggcatcagactcctcagccactgtcagcgcggacagcaagcttaaggccgaagtgtcctcctccatctacttccacaagcccagggagtcgcccccactcctgcccctgggcaccccttgctgagcccatgggggaacaggagcaggcacagagcaggcaggggaggggggccatgccgatccatggcggtctgctgattctttcacatggtctcactttggcctctctctcatcctgctgtttagagatggacttggcttattttgtcaacgactgggcttttcaaagctccatctacaaacaatgctgttcttaccctcagagggacctgccagccttgtccttcccacttgtagatggagatctgtctagccgttagagttgcccagcatctccatctggccaccctcgagcccgggcaaggccttttgcctgttctccctttggtcttaggatctgactattggctgagcccctccatcatcatgatggatcctgtgttgatgagctccaactattgttggaccactatgatgtcgatgatcatttctctacttctacctagctccctatcctggaccaggcacttctaggggggctcacctaaccaagcccaggattccattttttttttttttggttctttttttcggagctggggaccgaacccagggccttgcgcttcctaggtaagcgctctaccactgagctaaatccccagccccccattttttttttggttctttttttcggagctggggaccgaacccagggccttgcgcttcctaggtaagcgctctaccactgagctaaatccccagccccaggattccattttctaaagtgggtctgtcttagccctgaatgtcccttcccttttcccagaggagtctctcacttctgtcttccgttcttagaggtactgcggttgcattgcctgacccctgcctcccgttaggtgctttcctgtagaaggccattctggaaaaacaataaagtaggtacaacaaaaaaattaa

SEQ ID NO: 2587 - DNA, 664 bp, Rattus norvegicus
  Genbank Accession No. NM_145878
ggcacgagtctccttgctgcttttgtgctctcccgctcgccatggccagccttaaggacctggaagggaagtggcgtctggtggaaagccacgggtttgaggactacatgaaggaactaggagtagggctggctcttaggaagatgggtgccatggccaaaccagactgcatcattaccctcgacaacaacaacctcaccgtcaaaactgagagcacagtgaagacgaccgtgttttcttgcaccttgggagagaagtttgatgaaaccacagctgatggcaggaaaactgagacggtctgcaccttcacagacggtgccctggtccagcaccagaagtgggaagggaaagaaagcacgataacgagaaaactgaaggacgggaagatggtggtggagtgcgtcatgaacaatgccatctgtactcgggtctatgagaaggtacaatgaggactggctaactcgtcatcctggacagcagtcagctggctgagggaatagctcaattcaatgagcaggtcgtacagaaccacactgcttcacttctttggttttatttttcatgacttttcatcatagacactttacccgaaacccatgtcagaccgttggtttacccaggatcattcctttggttagtaaataaatgcgtttgtgctaattca

SEQ ID NO: 2588 - DNA, 2275 bp, Rattus norvegicus
  Genbank Accession No. NM_147140
  misc_feature (1)..(2275): n = a or c or g or t
agggcatcagcagttttgggctttgcagtgggcacttgcactggcatctacgcggctcaggcatacgctgtacccaacgtggagaagacactgaagaactactttaggtcactacgaaaggggcctgactagcccctgtggagaaggcaggatgagcatgttgggcctgcaggtagagaccttcctgtcacagccactctgcctggctccctctgctgttcatgtgctaaccccacccctcctgcctctttcctccctgcctttcttcctgcagagagtggacaatgcattgtcagcctgcaccctacactccttccctccctagttccatgggactgaccccaaaactacgggtcatgaaccccctcttcaagacctaactggaatgtgcagctgnctctgatcctcaagtattctctctggtgatgtaccacaagttctatactcaatttcctacaacccagtccctctgtccctttagctacccaggacacccaggatctggtgtgggccatgagtgtagaagatgggggtatgccaggcctagcccggccaaaacaggctcgctggaccctgatgctgttcctgtccactgccatgtatggtgcccatgcgccattcttagcactgtgccatgtggatggccgagtgcccttccggccctcctcagctgtgttactcactgaactgaccaagctcctgttgtgcgccttctccctcctggtaggctggcaaacatggccccagggcacgccaccctggcgccaggccgcacctttcgcactatcagctctgctctatggcgccaacaacaacctggtgatttatctgcagcgctacatggaccccagcacctatcaggtgctgagcaatctcaagattggaagcacagcgctgttgtgctgcctctgccttggacattgcctctctgcgcgccaggggttggcgctgctgctgctgatggctgcgggagcctgctatgcctcaggtggctttcaggaacctgggaacacccttccggggccccggtcagcagctggagcccgtcccatgcccttgcatatcactccactgggacttctgctcctcatcctatactgcctcatctccggcttgtcctccgtgtacacagagttgatcatgaagcgacagcggttgcccttggctcttcagaacctcttcctctacacttttggggtaatcctgaaccttggactgtacgctggcagtggcccgggcccaggcttcctagagggtttctctggatgggcagtgctggtggtgctgaaccatgcagtaaatggactgctcatgtcagccgtcatgaagcatggcatcagcatcacacgcctcttcatcgtgtcctgctcgctagtggtcaatgctgtgctgtcagcagtgctgctacagctgcagctcacagccaccttcttcctggccgcactgctcattggtctggctgtgtgcttgtactatggtagcccctaagtcattgaccacctgcactcacttgtggctgcgtagattagatgcaaccaccagagtcacctcccaggcctctgtgatccctctaacaagtgccttgtaagaaaagctaaggtgtccaggttagcctttgcatgttcagtgggagagttagccctaggagcagagtgggcttggttaaggaaacacctaactgcactctctgtgttccctcatctaaagaactgggagcccaaaacccaggcctgggcagcctgtccttgaagcaccctgccttgtcctgcatgtacatggctgcttcaagtgaagcttcagtcttctcacctgctgcggtcactcctgaagactttgtttccaagcttggtgctggctgctccagcccagcatgacttctgcagaagagatgcttagtttgccccctctacagtgctgttcccctttcccatccattattctggaaaggtcagagggagctggggcttgactcatctcagggaacattgcccctgggccctggcttaagcctacactcctgacccctgtgctaacccgagagccctgttgaagcccacgttacctctgaagcacttaggagggactgttcttcccactcttcagaggtgtcctaagttccaacaacttgggagggttctgcagagtaaccagggaccaggtccagaaaacatttatagccaatcagtgtcaaactacttcagcaataaggtcttaataaagtgtcctggctgtaggtgcttcctacaaccatttacaaaaaaaaaaaaaaaaaaaa

SEQ ID NO: 2589 - DNA, 4885 bp, Rattus norvegicus
  Genbank Accession No. NM_147208
ttccagggactaagccactacttaaagattatacatggactgaccctggactctgaccccataggtagcaatgaatattttagtaagagcaccagtggaaggggaagccctgggtcctgctaagactgaacccccagtgaactagtctatggggggagggcggcaatggggggagggttgggaggggaacacccataaggaaggggagggggagggggatgtttgcccggaaaccgggaaagggaataacactcgaaatgtatataagaaatactcaagttaataaaaaaaaataaaagtgagcaaacttgagtgcctgccagacttagccctgtatccaataactgtaacttgctgtgtcttattccccatgttgtcccacttgcttctccagtctgcatcttagtcagggttcctattgctgggccaaaatgctatgaccgaaagcaacctgggaaagggttattttgctcgcactaccatatcccagtctatcatgaaagggagttgggtatgaattcaagagaagaacctgaaaacagaactgaagcagaggctatagaagaatgctgctaatttccctctcccccatgctttgcccagactggtttcttataccaactagacaccagtagcagtcattaatcaattattaatccacgaaatatgcccgtagacttgcttacagacaaatcttatgggggtgtgttttcaataaagattctctcttcctagttatgtctagttttatgtcaagttcacaaaatccagccgtacaattgaacttttgccaacatggtaaataaacacatcgcttgtcacttcataactttttctttcctgttcattcccatgctctcatattaatatcaacatcacaatacaaaacactccaacttttaaaagtcccacagttttaaaacagtcaaccattttaaaagttcagtttttaattcaaagtccatttcaaattccaaggtctccagctgtggtctcttgtaaaatgaacattaagttacatcttacttcttctaagagggaagaactaggctacaattctaatcaaatcaaagcaaaacctaagttcaacaatgcgatatgccctgctctccatgacccctttatgccttcgaaatcagtaccacctgggacccccttccacattaccaagtctgactgctagcacaatgtgcaactttggctgcctctgcagaatagctttttgtgtgctgactccaaggaaacacttccaaatttatgaccctcaatcatattggtctcttcttaatcacagctatttcctcaactctagccgaccagcatcaattgtcctagcaaagcaaaatttctccttagtagttcctaatttaaaacatcacataaatgtctctgaaagagtcttatcttctccccgaaactccaagcaaggtcgccatcatctgccatgctatcatctgccatgctttttggccttatcttctacagtccaaacaggctcactgagctctgagcacaccatggcttttctaccccaaagtccaaatgatacacgatccttcccaaaacacataatcaagtctgttacagcaataatctactctctgcttataatttctgtcttaattagggttttgattgctgtgataaataccatggccaatcctaacttgtacagaaaggctttatttcagcttagagctctcagctcataccccatcatgaaggcaaatcttgctaaaaacttggagtcaggaaccgaagcggaggacatggaggaatgctggttcctggtttattcctcttggcttgctcagcctggttccttatatcaaaaaaggaccataagcccagaggtagcattacccatggagaactggatgcatcaataaatcaaccattagtctagaaaatatcacattacttgcctataggcctttatagtcacaatgactttatgaaattcataagcaaatggatggaactggaaaatatcatcctaagtgaggtaacccaatcgcagaaaaacacacatggtatgcactcattgataagtggctattagcccaaatttccaatgctcaaattaccccagatgcacagaacacatgaaactcaagaaggatgaccaaaatgcaaatgcttcactccttctttaaaaggggaacaagaatacccttgggagggaatagggaagcaaagtttagaacagaggctgaaggaaaacccattaagatcccgccctacatgtggcccatacatatacagccaccaaactagataagatggatgaagcaaaaaagtgcaggctgacaggaaccagatgtagatctctcctgaaagacacagccagaatacagcaaatacataggtgaatgccatcattaaaccactgaactgagaacgggaccccgttgcaggaatcagagaaaggactaaaagagcttgaaggggctcgagaccccatatgaacaacaatgccaacaaccagagcttccagggactaagccactacccaaagactatacattgactgaccctgggctccaactggataggtagcaatgaatagcctagtcagagcgccagtagaagaggaagcccttggtcctgccaagactgtcccccactgaacttaattgttggggggagggcggtaatggggggatggtggggaggggaggggaacacccatatagaaggggagggggaggggttaggaggatgtggcctgcaaaccgggaaagggaataacaattgaaatgtaaataagaaatacccaagttaagaaagatggaaaaaaaaaaagattcccagattgatgtctaggttggtgtcaagttcacaaaaaacaaactcctcattttgcctcttagtgcatttcccattggcagttactagggggaaagcacttgatagaagagatgaaaatagcttggtattgatgaatatgtgttgagggctatgcacataatacctttaggaactagtcttctgtgcttccttcaagattcttgaaaagaaaaactagtgaaggggggcaatttagattatacatgggaggacacagcactattctactgaatgaagataccataggataggcatggtcctctctgtgattaagatactgcctggtctttttgccctggaatgtttaaagaattgagtaacacagagtagtgagtctcagccttggataaagtcaaaccacgtaaattctaatgtaagagccattctcagattatctgggtcctcatgaggggacccaggcaattttaaacccaggtattcttttaagccccacaggaaacttgaatgtgtagctgagactgcaaacccctgagccagaaggagtaaccggtccatcaagggatcaatagctctcggacagatcagtcttcagaagcgagttgggtgcaatgtgtatttgacacttacaactagaacaagatctgttgtgatgtctttttttcagtggcagagtgattcctgcccttatagaacctttgattcacaggcagagataccagatgacctttcaatccacaacccaaagctgtattaaaaaccacattgtacaaaattgaccacattttatgccaccatctaacacttaacatcatcttgcatttgtatcgcatatgatttttctgttaagtcacgcggttatgaagaggctcatataaggtgtgcaattccctgacattctggatcagtccctcagcaataaagttcacaggaaaggaatgtatcatttttaagaatgttgataaaataccgacagattatcactcacaaaagctttacccatttcctctgttgcaatccaagcccacaaacaatattccacacttgagatgtcatttacaaaatgaaacaaatcaaaggaagtctgaataagacaaatgtgagaacgcagaatagagaaagacaggacttggatgaatgagggaagaccatacttggaaagactaattcaggctataatctcaagtgtaaagctcctcatctctgtaaacacctgagcaaagtttagggtacgcttctatatttttcatattttatgataataatggaagtgacagaatggaagacaaaagacgcatcagttttattgtctgaatcttataagtcccacaaggcttatatactacagacatgtgttattgttgaaacattgtaaaacctctaggatatggaccctggggggagggagttagttcattagaagtacacccctgagaagaatatgaggatactaatcacttcatcggtctcttcttcctccccaccatgaggtgagctgctgtggtatcatacagtgcttccacctagatggacaacctcagcatagaccccaactgaggccagaaaccacaaatgctacaacttcatttctataagttgattgtcttaggtagtttgttggagatgactaacataatcagtgatacgttttgaaagatcacaaatttccccaatttgacttactgagtcgactactggtgaaagaataggctggctgagtggctctctgactgcaatgactggttatgaagggaccttgcattctgtaattgatgaataataggacagatggaatagtggaaaacacacacttgattctgttttcttacatgtgctaaaacagcaaacaataaaccttatttgggatggctactggtacagcctttgttgatgctttggttttctaaagagcaaaaacattcagttgtctttctagttgagcatgcgtttaaatttcatgccattaaaaatacacattgcggggttggggatttagctcatggtagagcgcttgcctaggaagcgcaaggccctgggttcggtccccagccccgaaaaaaaagaaaaaaaaaaaaaa

SEQ ID NO: 2590 - DNA, 1996 bp, Rattus norvegicus
  Genbank Accession No. NM_147210
ggaatcccctctgagaacagtttccagtcctcgtcctcgtccgttccgtcttctccaaacagctccaactgtgatgccaacggcaaccccaagaacacggatgtctctagcattgacggtgttctcaagagcgaccgcacagactgtcctgtgaaaacaggcaaacctggtgcccctggcatgaccaagagtcacagcggaatgacaaaatttagtggcatggttctgctatgtaaagtctgtggggatgtggcctcaggattccactatggagttcatgcttgtgaaggctgtaagggcttcttcaggaggagcattcagcagaacatccagtacaagaagtgcctgaagaacgagaattgctccatcatgaggatgaacaggaaccgctgccagcagtgccgcttcaagaagtgtctgtccgtgggaatgtcgcgggaccgtgttcgatttggccggattcccaagcgtgaaaaacagagaatgctaattgagatgcaaagtgcaatgaagaccatgatgagcacccagttcggtggccacctgcagagtgacaccttagcagagccgcatgagcagtcagtaccaccggctcaggagcagctgcgcccaagccccagctggagcaagaaaacatcaaaagcacccctcctccttctgattttgcaaaggaggaaggtgattggcatggtgaccagagcccacaaggatacctttctgtataatcaggaacatcgagaaaactcatctgagagcatgccaccccatagaggagaacggattcccaggaatgtggagcaatataatttaaatcatgaccatcgtggcggtgggcttcacagccacttcccctgtagtgagagccagcagcatctcagtggacagtacaaagggaggaacatgatgcactacccaaacgggcataccgtttgtatttcgaatggacactgtgtgaacttctccagtgcttaccctcaaagagtctgtgataggattccagtaggtggatgttctcagactgagagcaggaatagctacctgtgcagcactggagggaggatgcatctggtttgtcctatgagcaagtctccatatgtggatcctcagaaatctggacatgaaatctgggaagaattttcaatgagttttaccccagcagtaaaagaggtggtagaatttgcaaaatgtattcctggcttccgagatctgtctcagcatgatcaggtcaacctgttaaaagctgggacttttgaggttttaatggtgcgatttgcttcgttatttgatgcaaaggagcggactgtcaccttcctgagtggtaagaagtacagtgtggatgacctgcactccatgggagcaggcgatctgctcagctctatgtttgagttcagcgagaagctgaatggcctccagctcagcgacgaggaaatgagcttgttcacagctgttgttctggtgtctgcagatcgatctggaattgaaaatgtcaactcagtggaggctctgcaggaaacactcatccgtgggcgcggaaggaccttaataatgaaaaaccatccaaatgaggcctccatttttacaaaattacttctaaagttgccagatcttcgatctttaaacaacatgcactctgaggaactcttggcctttaaagttcatccttaaggcctttgaagatcaatcgatgctaatgtacattttatgctgagatgtttatttatatgtgtataccatattgtgaaaatagaaaaggactagcgccaggtcctggacagtctgtagtcagtcaccagtagctgttcaaatgagaactcattgtcttgttaaacattggcccaccctccctgtaaaccaaccagctgtgttgcactagactggagaagttacactgaattataatcacactgaatgttagactttttcatctgccaaagccaaaataccatttgatctccccgtggtataaatctagacgcacattgcagatataggaggg

SEQ ID NO: 2591 - DNA, 4359 bp, Rattus norvegicus
  Genbank Accession No. NM_147211
gccaggcgcgcagaagcaacgccaggcactgccggcagatcaactgggatcctcgaggcggcaagaggacagggacagcggggaccgcgactccagtaaaagtccagtcggcccggttacggccagctgcagaccagaacctactctcttggagccatttgtaagcaagagacgccaacgctgtgtgacatatgccggtgccaccaccaccacccccacctcttcctccaccccctccacctctgggagctcctccccctccacccccaccagggcccccgatcagcacagacgctcccagcttaaggaagtcagatctgaaaggtcggagtgcactgttggctgatatccagcaaggaacacgcctgcgaaaagtcacccagatcaatgaccgcagtgccccacaaatcgagagttcaaaaggaaccagcaaagagggaggagctgctggcagcaatgcccgtggaggaagcacgccccctgccctgggagatctctttgctggtggctttcctgtgttgaggccagcaggccagcgggatgtggcaggtggcaagaccggacagggccctggctcccgagcgccttctccccggctccccaccaaagccatcagcggcccccttcccgctcctgcatcccccaggctaggcaatgcctcagatacacacagctctgccaggccagtccctcctcgccccagtgtacctgccccaccgcctcccactacacccccacccccgcctccacctccacctccacctccacctccacccctccccccagcctcccccatcaaagccccatcggtgtccccacctgtccctccaaccaaggggaatccgtctgcggtgccagcccctataccctgcgtacctccccttccgccccctcccccgactccgccccctctgcccccagcctcagcactcagtgagaaggcagtgaggccccaactagccccgctgcacctgccacccataccacctccgcttcctctcctgccaccctatgggtacccggcgctccactcagagcccagcagccctgcccaggacgtgagagagccaccagctcctcctccaccaccgccaccaccaccaccacctccaccaccaccgctccccacctacgcctcttgctctccaagggccgctgtggccccgcccccgccccctttgccaggctccagcaacagcggcagcgagactcctcccccgctgccccccaagtcccccagcttccagacgcagaaagccttgcccacacctccaggtgctcccggccctcagatcatcctgcagaagaagcgtcgaggcccaggagccggtgggggaaagctaaacccacctccagccccacctgcaagatcgcccaccactgagctctccagcaaaacccagcagcctggaggacagctgcggaatggaggccagcacgtgattggccgcacacctggttcctggctccaagctgaggcagctgggcagagctctgatgacatcaaaaccagaaattctcagttatctctaaaggcactccggtgagaagatggtgacgtcaaggtcctggggttctggactagacaccaggacaactccttgagactctactgtactcaagatctactcctttgaatgcaggcaccgaactgagcatttattttttttgtaaataatgatttgcatgaagcccttaggcaccatgttagtcaactttcatttgagtaacattttaatatttttaaaacaagcaccctgacatttgtccgtcttgtacagatggctcccgatcccgccctgtggtgtccactgtgactagaacatatgcttgcaggctggtccttcgaggattctgaaaccttttccagagcatccttagttttcgagtagtccaaaagtcataactatccacaacagcttcttattggcatgactctcatcactccaaccgcaaaatcaaaccaaataatgccttataaaccacgcagctcagaggaagcagtgtgtcgccaggtcctggtgttgccactcagcttccagtgagcgagaagccatgtctcgcttccttttagcagtacagggacgtcattttgctgcctaatgtgtgtatatatatatatatttatatcccaaggtaaaggctagagtgggcgtggcccctcccatgccttccgcagggccccttttgtaactgaattcttttacaggtagccaatgctcttactgtttacagcatccccagcgccagtctttaccgctttccttcaacacctccaagttcccagctccatgctggtagccagggtaaagtcagctttatgagattttgatatcctcccatccctgtagactacggttgtatatagctcatgattatgaataagtttatttttacctcagaagtctccctccccaaactctactcagagtgtaagatttacatggaaaatacaacatatatttaaaaagaacaagaataaaaggaggctggagaaatagacccactggtaacatgcctgctaaggacatacacacagagctggatgtggtaacacacacttgttattccattactgggggagcagaggcaggcagatccctgtgactcactggccagccaagctattcaaggagcctcaggttccagaaagtggcattgtctcaaaatacaaggtggcaactcctgaggccacaacacccaaagttgacctctggcctcttacaggttcacgcatgacatgtgtgcacacatcccacacagggacatacacactcatacagaaacacatagcaaagagcagagcagctcttggagcatatctcaaatatcctgccccattggtaggagtctcagaatacccatcagcccaaaggaccttctctctgagcttcatctgagagcgcagatggctctgttgcctggtggcgtgtgcctgggatgcccagcagtaataggcagcgagttcagctgtcctgaatagacagagggccacgcaggctggggctgctctctgcacccttctttgaatctcaagggagaaaagtatgcttttgcttcttgtcaggccccaaatgctcccatccactggagaggggaggctgtagcagaggagggggaaatgggaggaaacagtccgatccctcactgtattcagaatagctgcagacagaagagaggggaaatgaaacaatggtgttgctttggagcactccgaccacaagaacattagcccaggccgggccatcaggggccaatggattaggagagtgttcagctgtgtgtctgcacacacctgactattgtttggagcaaatgtcctgcattagtgtcatgctttctcctgccagataggagaaactgagccagggtcaagtttccaaaatctctggggcagtgactcaaggccgtagttacagccacatcagcagacatgacggttctacgttgctggtttgttacggtggctctggaagtgtgcagaaaggtcagaagccacactactcttctcctagccatgcagagtaataatcattaaaaagctttcataactacgatgagggccatcaggaaggcagtcctgcctttggaatcagtgaattgttcacatacggtgtatgttcaccatgtattcacatggtgatgttctatactgctggcacaggaatttaaactattcaagagtgggggagatgtctctgtctgtagacatcctgctgcccaagcatgaggaccggaattcatatccccaggacctatataaaagtcaggcatgggggaagcatgtctgtaatcctagaagttgggtagaggcatctgccccaggaaggtcggtggccagccaacctagcaaaatttgcaagttgcaagctgcaggtttagtgagaataagatagagatagaccaaaaaagatacctgtagatggcctttgggcttcacatgcatgtgcacacatgtgccttgttcatatgcacacacacacacacacacacacacacccgtatatataatacataaatattttttacaaacttatttaagggcataaggaaggaacaagcagaaaccaaaaaatagcaagcaaggagcattctcagggatctggcctagcagctctcctcaagacctgtcacggagcctaccacctccaagttcaagtgggtacgttcggttcccaccagcagtgtacaggttaggcctttgactgtgaactcacgcatggagttgtccctgctatccttgcccacccccacattgcagactgtgaccctgccccatgtctctgcctgtattttatatttattggtgtctcctgctgcagattcattcctttgtacctaataaactttaataagtga

SEQ ID NO: 2592 - DNA, 976 bp, Rattus norvegicus
  Genbank Accession No. NM_152935
gtctggactgcagacaggcggcacggagagaccggcgagctccgatcggtcggagctaaccgctgccaggcggctgccgcggccccgcacacgccccagtcgagcgaagatggtgggccggaacagcgccatcgccgcggggctgtgcggtgccctcttcatagggtactgcatctactttgaccgcaaaaggcgaggtgaccccaacttcaagaacaggcttcgagaacgaagaaagaaacagaagcttgctaaggagagagctgggctttccaagttacctgatttaaaagatgctgaagctgttcagaaattcttccttgaagagatacagcttggtgaagagttattagcacaaggtgactatgagaagggtgtggaccacctgacaaatgcaatcgctgtgtgtggacagcctcagcagttgctgcaagtgttacaacagactcttccaccaccagtgttccagatgcttctgaccaagcttccaaccattagtcagagaattgtcagtgctcagagcttggctgaggatgatgtggaatgagccagacaccaacatgataaatctcagtaaaatgataacagttagctgcaggctgctctgctcggggggataagggcaaactgtgcttgtcatgaactgtctcacactgacatctccaaagtgaacctgaactttggtagagccattgtctgttctatttatttttccagtgagaagtattttgatagcttttcattttataaatacactgcgttaaccaaaagatcatggatttcgtttgttcttgacatgcagttcaatgtaaatacagtagtattaggtagagactcctggtgattttaaaggattgaaaagctgaggaatagttgaataatgcacattttaaagactagaacattttattgtcgttgtaaaattgagtagaaacttgtgtttgtgaaaactgagcattaaaaccttacagagaca

SEQ ID NO: 2593 - DNA, 379 bp, Rattus norvegicus
  Genbank Accession No. NM_152936
tcagtttctgaagagaagcaccctgcacagttcttctgagttttggacctaggtctacaaccatgaaggtagcaattatctttcttctcagtgctttggccctgctcaatttagcaggtaacactacagctaaggtgattgggaaaaaggctaattgccctaatacacttattggatgccccagggattatgatcctgtgtgtggtactgacggaaaaacttacgccaatgaatgcattctatgctttgaaaacaggaaatttggaacatctatccgcattcagaggagagggctttgctgaatgtcctgatttcgaaatcttttagggctaccataatgtttagcaagaaggtttgctgaataaatgcatctgaacat

SEQ ID NO: 2594 - DNA, 4521 bp, Rattus norvegicus
  Genbank Accession No. NM_153629
cggcgcctcttctgcggccgtggagccggagccggcctgagcggtagaggcccgtctttttcaaggacccaagcatcctcgtggacggtcgtccggcttcgcccgcccagccgcggtgctccatcagcccacgcggcgcgccctctccacgcgccaaccccgtcgggttccgtgtgcagtgtcggcggccggccctgggcccgagcccgagcagtagccggcgccatgtcggtggtgggcatagacctgggctttcagagctgctatgtcgctgtggcccgcgccggcggcattgagacgatcgctaatgagtatagcgaccgctgcacgccggcttgtgtttctttcggtcctaagaatcgttcagttggagcagcagcaaagagccaggtaatttccaatgccaagaacacagttcaagggtttaaaagatttcatgggcgtgcattctcagatccatttgtggaagcagaaaaatctaaccttgcatatgatattgtacagttgcccactggattaacgggcataaaggttacatatatggaagaagagaggaattttaccactgaacaagtgactgccatgctcttgtcaaaactgaaggagacagcagaaagtgttcttaagaagcctgttgtagactgtgttgtttcggttcctagtttctacactgatgcagaacgacggtcagtgatggatgccacacagattgctggtctcaattgcttgcggttaatgaatgaaacaactgcagttgctcttgcttatggaatctataaacaagaccttcctgccttagaagaaaaaccaagaaatgtagtttttgtagatatgggacattctgcctatcaagtttctgtatgtgcatttaatagaggaaaactgaaagttttggccacagcttttgatacaacattgggaggcagaaaatttgatgaggtgttggtaaatcacttctgtgaagaatttggaaagaaatacaagctagacataaaatctaaagttcgtgctttattgcgactctctcaagagtgtgagaaactcaagaaattaatgagtgcgaatgcttcagacctccctttgagtattgaatgctttatgaacgatattgatgtatcgggaaccatgaatagaggcaaatttttggagatgtgtgatgatctcttagcaagagtggagccgccacttcgtagcatcttggaccaatccaagttaaagaaagaagatatttatgcagtggagatagttggtggagccacacggatccctgccgtgaaagagaagatcagcaagttctttggtaaagaactcagcacaacattaaatgcggatgaagcagtcactcgaggctgtgctctgcagtgtgcaatcttatcacctgctttcaaagtcagagaattttctatcactgatgtggtaccatatccaatatctttgaggtggaattctccagctgaagaggggtcaagtgactgtgaagtcttccccaaaaaccatgctgctcctttctccaaagtcctcaccttttatagaaaggaaccgttcactctggaggcctactatagttctcctcaggatttgccctatccagatcctgctatagctcagttttcagttcagaaagtcactccacagtctgatggctccagctcaaaagtgaaagtcaaggtccgggtaaatgtgcatggcattttcagtgtgtccagtgcggccttagtagaggtgcacaagtccgaggagagcgaggagccaatggagactgatcagaatgcaaaggaagaagagaagatgcaggtggaccaggaagaaccacatactgaagagcaacagccacagacaccagcagaaaacaaggcggagtctgaggagatggagacctctcaagctggatcaaaagataaaaagatggaccaaccacctcaagcaaagaaggcaaaagtgaagaccagcaccgtggacctgcccattgagagccagctgctgtggcagctggaccgggaaatgctcggcctgtacacagagaatgagggtaagatgatcatgcaggataaactggagaaggaacggaatgacgccaaaaatgcggtggaagagtatgtgtatgagatgagagacaaacttagtggtgaatatgagaagtttgtgagtgaagatgatcgtaataattttactttgaaattagaggatacagaaaactggctgtatgaagatggagaagatcaaccaaagcaagtttatgtagacaaattggctgagttaagaactttaggtcaacctattaagacacggttccaggaatctgaagaaagaccaaaattatttgaagaattagggaagcaaatccaacagtatatgaaagtgatcagctctttcaaaaacaaggaggaccagtatgaacacttggatgctgctgacatgacaaaggtagagaaaagcaccaatgaggcgatggagtggatgaatagtaagctgaacctgcagaacaaacagagcctgacggcggatccagttgtcaagacaaaagagattgaagctaaaattaaggagctgacaaatatttgcagtcctataatttcaaagcccaaacccaaagtggaaccccctaaggaggaaccaaaacatgctgagcagaatggaccagtggatggccaaggagacaacccaggcacccaagctgctgagcacggtgcagacacagctgtgccttctgatggtgacaagaagcttcctgagatggacattgattgattccaacacttgtttatattaaaacagactattataaagctttaagttgtcaactttgttctgaatatcaactagagcaagcaaatactggagatttcttagtcagtttttaggggatctcggggtggggtatataggtaatatacagagcattttgacttctaaatagttagatccagagatgaagtgcactgttctctcttcattatgatcctgtttaagagcccagctagtctttctgagctcttgcctccctccttgttttaatcatgcttctacaaggtgaagtgtgtttggggaaactgagctctaacaaaagctgtgagagccactaggcaggcttttcctcaaacatgacagaagttcaaattatgcttggaaaggctgagtggagatcaccaccagcattctctgcctgtggggctgtgggactgtggggctggtgcttcctccatttctgagggtctgagaatggcccagcatgcattaacacaggagagcgcagagcgcagcagggcctgctctcattgccctctattcccagccctgtcttcctcttccgtccgcaagcagtataaatgccatgtgccctctgcacttagagtgagccttagcgtatcaaggggctttgacgtggctccccgtacttcctgaaagtattcactgacactgaagcgtcagagtctagtgtaaccttaaggtaggttgtaaataacagttggctgtaggcatggtaagtctgagcagcccatccttagtgtggtgggaaggtctgtaccctgacctgctccacggtagatggtgtatgtaaattagaggtttcgatggaacaggatgagagctcaaggttctttgtttggtattatttgtgttaatgtgtcttgaatctgccaatctgtatgttaaaacagctgacagattgtaaagctattgccctggacaagtctgaaattagtgtaaaagaaaacctcatcgttaactgcagccgctgtcagggtaccatatattcctggaacaagtctatggggaagagatgttctgcagacaaagggacggatgcctatggtagaggtcagagttggttacctgccttagttacaagtgttacgttctgggtctttgtaatcactgatctctgtaacagagcctctgtttattcttgcttgttggaaataagcttaaaccatgcatagttagaattactatgcttctgtctacacaggaagtgctgtagctctcaagtgctctagaggccattggttggagaggaaggaatgcatgcttatgttatgtaagcaactggactcccgctcagtacaggcctggagctccaggccgagtgcatactctgctgctttgagtgctgcaggagtgcccactggcctggctgtgaggctgatagctttttcaagtgcaggctgcaggattaagccaactcttatgcaactgactgtccttaatgatgatctcataaacatttgtgtgtgggggtgggagggtttgggtgtcgggatggggaatgaatttgaagtctaaagttaaagctagaaatcagatgatcagcttctgctctgtctatatagacgattggatttatgtggaggcaggccagatggcaactgatgacttgtgtgcaaacaagcatttatccaggttgcaatatccaaattggtttgttaaaaactctaggtcacattcttacactaagaaaaacagtaaacatgagacaaagtttaggaaaaactaataaaagaaacctgtcttaacttgaaa

SEQ ID NO: 2595 - DNA, 1375 bp, Rattus norvegicus
  Genbank Accession No. NM_153821
ctttttttttttttctttctgatttaagcttagcgtgtttgtttgtttggtttggtttttaaactttttttggtgtggattatctctctggaccacgccggacttggcttcagcgaacgaaccgaagctgggagaaagttacttgagctgaaagttctgcacttcagaagggggtttctctctctctctctctctctctctctctctctctctctcctccactcccccctctttcttccccactcggctcctctcccccctcacgcccacagcgtttggtgttgattcgagcgttaagaggggggtgggtgggattggagggaagaccatgacctccagctacgggcacgttctggagcggcaaccggctctgggcggccgcttggatagccctggcaacctcgacaccctgcaggcgaaaaagaacttctccgtcagtcacctgctagacctggaggaggccggggacatggtggcggcacaggcggacgaaagcgtgggcgaggcgggccggagcctgctggagtcaccgggactgaccagtggcagcgacacccctcagcaggacaatgatcagctgaactctgaggagaagaagaagagaaagcaacggagaaacaggacaaccttcaatagcagccagctgcaggccttggagcgtgtcttcgagaggacccattacccggatgcttttgtacgggaagatcttgcacgtcgggtgaacctcacggaggccagagtgcaggtgtggtttcagaaccgaagagccaagttccgcaggaatgagcgagccatgctggccaataaaaacgcttctctcctcaagtcctactcaggagacgtgactgccgtggaacaacccattgtacctcgtcctgctcccagacccaccgattatctctcctgggggacagcctctccgtacagcgccatggctacttattctgccacatgtgccaacaatagccctgcgcagggtatcaacatggccaacagcattgccaacctgagactgaaggccaaggaatatagtttacagaggaaccaggtgccaacagtcaactgaggaaaaaaataattaaacaggcctaagaagaaatcaaaaaccataagacacctatcctgttctgtcatttcttcatccgctggaaaaaaaagataaaagcaaacaaacaaagccagaactaaaatattgggaccatggcggagaaaagcaggagaggaacaaaatgaaaattagttaacaaatgtttcttcttcctcttggataccatcaccatttgttgtgtgtgtattttttttccttctacccatgctttgctaagtatacttcaggcttcttctattaggctcaacccacccattcctataattg

SEQ ID NO: 2596 - DNA, 1456 bp, Rattus norvegicus
  Genbank Accession No. S56464
aattttgtaagtaatgtatttatgtgttcctttgttctgtatatagctggccagggtctcctgactcggcctcatgagtagatcattgtagttctggatatgagacactgactggctctagaaatacctcattcacccgtgggaagaggagataggtagaacctcttagtgggttattggcagagcgccaacctcctggcttcaccttcctccggggtctgtgaggtgtatgcaaggcaggaagggagactgaggctggtcccctgggggaagggagccatagatagcagctggctgctccgtccaggtgctttcctgactggtctcacccaggatgttagccaaagaaaaccaaagggtttgttctcactgtgtagagggctcagtttgtaggtcagtcagtgttttaagacggtttgacaaataaaaggaagccaccaaacactgtttttaaagtcatctgattgttggagcagaccatacaaagcattgagagaattcaaccaagcctcagggatgtctcgggggtgttggtgcatttgccctcctagcagatcccacctccggtttgtcttgtgttttacacgagacgttcgatgtctgtctgcttcctcagactgagccacaccgagctgccgactctcctttttatacatgttatttattccggactgttcgaggaacgggaggacgtcaatgccctgttctctgctctctgagtacggttcgctctgaatccgaaagttcacctctcccttcaaaatattaaattgaccaccaacattaaacctggataggatgtaataaagaaggaatagccttgcaacactaaaacagagataacataaagaccaaaagaaaactcaaccttgtagcccctaagttttgaacatctttcaaatgtgtgctgagcagagcctggttacatccgaacaagctccctgggatgcccagagggaaggtcgaatgttgatttgttccaggctggcactgcctatctggtgtagctccctcaacctgcagtaaccgaaacagacctgaaaaccaaagccatctatagatgtgtacaccactagagggtagccacggagtgcagatggattctgactaaagttttcaatcttgaatttaaaacttttaaaatcaagcaccacctaggaaggacacttttttttctttttttaaaggtgaaggtgtgtgtgtgtgtgtgtgtgtgtgtgtgtgtgtgtgtgtgtgtgtgtgtgtgtgtgtagctttttaaggaagttggctttcaatccagagcatgagacagtgtgctgtgttcctagcactaggttgacagccctctgctaagctactttgtggtatcaatgacctttgactcatctcaaatccctgggcactcggttttgtcactatgtacagtagagaactagttgaaattaaccatgtgatgttaactattattaataaa

SEQ ID NO: 2597 - DNA, 462 bp, Rattus norvegicus
  Genbank Accession No. S56679
gctgccttcctgactgtggagaggatggtgtctcccattgagagtgcagaggacctggcaaagcagacggaaattgcttatgggacattggaagcaggctccactaaggagttcttcaggagatctaaaatcgctgtgtttgagaaaatgtggacatacatgaagtctgcagaaccatccgtgtttgttcttaccacagaggaaggcatgatcagagtgagaaaatctaaaggcaaatacgcctacctcctggagtccaccatgaatgagtatatcgagcaacgaaagccctgtgacaccatgaaagtgggaggtaacttggattccaaaggctatggcattgcgacacccaaggggtccgccctgagaaatccagtaaacctggcagtgttaaaactgaacgagcaggggcttttggacaaattgaaaaacaaatggtggtacgacaagggcgagtgcggc

SEQ ID NO: 2598 - DNA, 126 bp, Rattus norvegicus
  Genbank Accession No. S59892
gtgtttggatgattaaaatatgaaaaggaagattcttcctcttaattgcctttgtaatatgagaatgtattagtacagacttgtaaaatatatactgtataaaaattagccaatagttctttcttc

SEQ ID NO: 2599 - DNA, 106 bp, Rattus norvegicus
  Genbank Accession No. S59893
gtgtttggatgattaaaatatgaaaaggaagattcttcctcttaattgcctttgtaatatgagaatgtattagtacagacttgtaaaatatatactgtataaaaat

SEQ ID NO: 2600 - DNA, 1892 bp, Rattus norvegicus
  Genbank Accession No. S61960
aaactgaccaaggagtatgatcaatcccgtccagcctccgagcctgcagccgtttggtcatggtgagctgcttcagctaacaattgcactgacagtgctcttgagccaagttgcttctgggcggaagtagtccatctagggctcggcctctttaaagaaacagacttctgcaaccttgggactacgtttggggtcgccggctattggacggagcagcgcaattgttagctgaagcagctcaccatgaccaaacggctgcaggctcggaggctggacgggattgatcaaaacctctgggtggagtttggcaaactgaccaaggagtatgacgtcgtgaacttgggtcagggcttccctgacttctcgcctccggactttgcaacgcaagcttttcagcaggctaccagtgggaacttcatgctcaaccagtacaccagggcatttggttacccaccactgacaaacgtcctggcaagtttctttggcaagctgctgggacaggagatggacccactcacgaatgtgctggtgacagtgggtgcctatggggccttgttcacacgctttcaggccctggtggatgaaggagatgaggtcatcatcatggaacctgcttttgactgttatgaacccatgacaatgatggctggaggttgccctgtgttcgtgactctgaagccgagccctgctcctaaggggaaactgggagccagcaatgattggcaactggatcctgcagaactggccagcaagttcacacctcgcaccaagatcctggtcctcaacacacccaacaaccctttaggaaaggtattctctaggatggagctggagctggtggctaatctgtgccagcagcacgatgtcgtgtgcatctctgatgaggtctaccagtggctggtctatgacgggcaccagcacgtcagcatcgccagcctccctggcatgtgggatcggaccctgaccatcggcagtgcaggcaaaagcttcagtgccactggctggaaggtgggctgggtcatgggtccagataacatcatgaagcacctgaggacagtgcaccagaattctatcttccactgccccacccaggcccaggctgcagtagcccagtgctttgagcgggagcagcaacactttggacaacccagcagctactttttgcagctgccacaggccatggagctgaaccgagaccacatgatccgtagcctgcagtcagtgggcctcaagctctggatctcccaggggagctacttcctcattgcagacatctcagacttcaagagcaagatgcctgacctgcccggagctgaggatgagccttatgacagacgctttgccaagtggatgatcaaaaacatgggcttggtgggcatccctgtctccacattcttcagtcggccccatcagaaggactttgaccactacatccgattctgttttgtcaaggacaaggccacactccaggccatggatgagagactgcgcaagtggaaagagctccaaccctgaggaggctgccctcagccccacctcgaacacaggcctcagctatgccttagcacagggatggcactggagggcccagctgtgtgactgcgcatgtttccagaaaagaggccatgtcttgggggttgaagccatcctttcccagtgtccatctggactattgggttgggggccagttctgggtctcagcctactcctctgtaggttgcctgtagggttttgattgtttctggcctctctgcctggggcaggaaagggtggaatatcaggcccggtaccaccttagccctgccgaggctctgtggcttctctacatcttctcctgtgacctcaggatgttgctactgttcctaataaagttttaagttattaggaccctc

SEQ ID NO: 2601 - DNA, 2012 bp, Rattus norvegicus
  Genbank Accession No. S63519
cggtcccacttgcctctaaatgcagacagtgagtacgtcacattaagtgaccaccacttcttagggactgccagtagcagggggaatgatacggccagttgaggcatttagcagtggaactgttctataagtgggtatttattttcgacaaggtaggccacactggcctcatctgctctgagtcttcctaatatagaaagtcatggaagttgtatgtagatgcctttgtgttaaatcttgcttcagaatcagagtgggatctctgggacacataccaagctcgtttgccttcattctgtattttgtttctttgataaaataatgattttcattttttgcttaatactacattcttaagctacatagactctctccgtgatacaacaggcagtgcatgctgttactagttcttttctcctagtaaggcctacacagttatttcttgttaagaagctgtgagatgtgacctccttcctgcttagcatcacacagaaaatctgatttcaagtatctcacttattcccaccgcatcactgtcagaacagcctctcagattcacccaaagaaatacaatcatgatgactcaaatggtgtataactcaggtccagtaattctgcataggtaatcagttaaaacagtttaaacatgaaattgattcaaatattgataatgttttactaatgtgagcaacagtgttatggaaaggattcatttgactcttgtggaatgggcctgtctaatttttcttaacataatcggtaaagtattactaagaaatgctccatcctgtttctgtccaagaaaggaaagcgatacctcctgctccctgaggtggcactagggatttaaccgggaccaggaccgcctgcacgctaggcaagcactctacaaatgagatatattcctagaccaacaaatccttttgttcttctaataatttgtttaaggagtttaatcttgaactccagatgcccgcatagtcttatctgggaagatattcgtttatttctcattttgtcacccatatctacttttttcttagaggttgatgtacagatatctaaaaatatgtattcctcaatgatcttatttaggagagtgtttttactgtcatatttaaaaatagattattttcatgctgccttctgttgattttggcaaattgtataatagatcgtcttgatcattgcattttttgtcttgtaaatgtatattttgtctttgtaaattcatttacttctcaggtgtgactttatggttgactttaaacgtatgaatgaatgaggatgtaaggaaagctgtcttatttattaacgtagatgcggtaaaagaagggtatttgggtttgagcttctttttatttgagtatagaaagttatgcttttaagtaaagaaatagcaagtacagaggaaataaaaataaatagaagaaagtaaaaaggaaaaaaaccctaagaaaatgaaacaaaaaaaaagatgtaagcgaaagcaagccacatgtgatggccaatgcctgtgaccagcacttgagagactaaggcaggaagaatactacaagcttgaggcatgtgtggtttcagagtgactttgaagcccgtctgggccatagagtaagaccaggttttgttctggagaacataaacaagagtatatgataattacagggaatagtctcatggatttacataaagacaacaagagggcttaagtggagatgtgtggtgctgaagtcttgcagattggaggcagggcctgacagagcatccaccattaccaaaatccttaggatctgggagcaacaccatagctgccaagggtctgatttaaatctgttctactcactggtcagcatattggactctgctactaatataatgttaaaatagcatacctggtaaaaataaaatacacgaagtgtgttgagtgtttgagatgaaagtaaaagaaaacctaaatcattgggcaacttgggaggaaaatcattttaaataaacaaatcacatcattaccg

SEQ ID NO: 2602 - DNA, 800 bp, Rattus norvegicus
  Genbank Accession No. S69206
tcttctcttgccttctggagctggagctgaggagattatcggtggtgtggagtctagaccacactcccgtccttacatggcccatctggagatcaccactgagagaggttacaaggccacctgtggtgggtttcttgtgacccgccaatttgtgatgactgccgcacactgtaagggaagagaaaccactgttacccttggagttcatgatgtgagcaagacagaatccacacagcagaagataaaagtcgaaaaacaaattgttcacccaaattataacttctattccaatctccatgatatcatgttactgaagcttcaaaagaaagccaaggtgactcctgctgtggatgtaattcccctgcctcagccctctgactttctcaagcctgggaagatgtgccgggcagctggctgggggcaaactggagtgacaaaaccaacctcaaatacactgagggaggtgaaacagagaatcatggataaagaggcctgtaaaaactattttcattataactataacttccaggtctgcgtgggcagtccaagaaagataagatcagcatataagggagactccggaggaccactagtgtgtgctggggtggcccatggtattgtatcttatggacgtggagatgcaaagccccctgcagtcttcacccgaatctccccatatgtgccctggattaataaagtcataaagggcaaggatctgaccagcctgagtctgcacgagtcagagtctccaagctagagaactcttttgatatcccttgggatcaacaaagcctgtcccc

SEQ ID NO: 2603 - DNA, 195 bp, Rattus norvegicus
  Genbank Accession No. S69316
actctcactatgaatcctgtgtggagagggaatgtgacattttaaagttatttcttttgagagacttgttttggatgctcccccaagcctccctctcccctgcactgtaaaatgttgggattatgggtcacaggaagaagtggtttttttagttgaatttttttttttaacattcctcctgaatgtaaatttgta

SEQ ID NO: 2604 - DNA, 2090 bp, Rattus norvegicus
  Genbank Accession No. S75280
ccgtctgtggggtgtttgttcttgccctcgtagccctctgtccagccgccatgataagcgccagcagagccgcggccgcgcgtctcgtgggcaccacagcgtcccggagtcccgccgccgcccgtcaccaggatggctggaatggccttagtcatgaggtttttagatttgtttcaagaagggattatgcgtcagaagcaatcaagggtgcagttgttggaattgatttgggtactactaactcctgtgtggctgttatggagggcaaacaagccaaggtcctggagaactccgaaggtgccagaactaccccttctgtggttgcctttacaccagatggggagcgacttgttggtatgccagcaaaacgacaagctgtcaccaacccaaacaatactttctatgctacaaagcgtcttattggacgacgatatgatgaccctgaagtacagaaagacactaagaatgttccctttaaaattgtccgtgcctccaatggtgatgcctgggtggaggctcatggaaaactctattctccgagtcagattggagcgtttgtgttgatgaagatgaaagagactgcagaaaattacttgggccatacagcaaaaaatgctgtgatcacagtccctgcttatttcaatgactcacagcgacaggccactaaggatgctggccagatatctgggctaaatgtgctccgagtgatcaacgagcctacagctgcagctctggcttacggtctggacaaatccgaagacaaagtcattgctgtatatgatttaggtggaggaacctttgacatttctatcctggaaattcagaaaggagtgtttgaggtgaaatccaccaatggggacactttcttaggaggtgaagactttgaccaagctttgttacggcacattgtcaaggagttcaagagggagacaggggttgatttgaccaaagacaacatggcacttcagagggttcgggaagctgctgagaaggctaaatgtgagctctcctcatctgtacagactgacatcaacttgccataccttacaatggatgcttctggaccaaagcatttgaatatgaagttgactcgagctcagtttgaaggcattgtcacagatctaatcaagagaactattgctccgtgtcagaaagctatgcaggatcgagaagtcagcaagagtgacataggagaagtgatcctggttggtggcatgacgaggatgcccaaggttcagcagactgtgcaagatctttttggcagagccccaagtaaagctgttaatcctgatgaggctgtagccattggagctgccattcaaggaggtgtgttggctggtgatgttacagatgtgctactcttggatgtcactcccctctctctaggtattgagacacttggaggtgtctttaccaagcttattaataggaacaccactattccaaccaaaaagagccaggtattttctactgctgctgatggacaaactcaagtagagattaaagtgtgtcagggggaaagagagatggccggagacaacaaacttctaggacagttcactttgattggaattcccccagcccctcgtggagtgcctcagattgaagttacatttgacattgatgccaatgggattgtgcacgtttctgccaaagataaagggacaggacgtgagcaacagattgtaatccagtcttctggtggattaagcaaagatgatattgaaaacatggttaaaaatgcagagaagtacgctgaagaagaccggaggaagaaggaacgtgttgaagcagttaatatggctgaaggaattgttcatgacacagaaaccaagatggaagaattcaaggaccagttgcctgctgacgagtgcaacaagctaaaggaagagatttccaaaatgagagaactccttgctcgaaaggacagtgaaacaggagaaaacattaggcaggcggcatcttcccttcagcaggcatcattgaaactctttgaaatggcatataaaaagatggcatctgaacgggaaggttctggaagttctagcactggggaacagaaggaagatcaaaaggaagagaagcagtag

SEQ ID NO: 2605 - DNA, 2275 bp, Rattus norvegicus
  Genbank Accession No. S76466
ggcggcggttactatggcggagtcggccggagcctcctccttcttcccccttgttgtcctcctgctcgccggcagtggcgggtccgggccccgggggatccaggctctgctgtgtgcatgcaccagctgcctacagaccaactacacctgcgaaacagatggggcctgcatggtctccatctttaacctggatggcatggagcaccacgtacgcacctgcatccccaaggtggagcttgtgcctgctgggaagcccttctactgcctgagttcagaggacctgcgcaacacgcactgctgctatattgacttctgcaacaagattgacctgagggtgcccagtggacacctcaaggagcctgagcacccctccatgtggggccctgtggagctggtcggcatcattgccggtcctgtcttcctcctcttcctcatcatcatcatcgtcttcctggtcatcaactatcatcagcgtgtctaccacaaccgccaaagactggacatggaggacccctcatgtgagatgtgtctctccaaagacaagacgctccaggatctcgtctacgatctctccacttcaggatcgggctcagggttacccctttttgtccagcgcacagtggcccgaaccattgttttacaagagattatcggcaagggccggtttggggaagtatggcgtggccgctggaggggtggtgatgtggctgtgaaaatcttctcttcccgtgaagagcggtcgtggttccgggaggcagagatctaccagactgtcatgctgcgccatgaaaacatccttgggtttattgctgctgacaataaagacaatggcacctggacccagctgtggcttgtctctgactatcacgagcacggctcactgttcgattatctgaaccgctacacagtgaccattgaggggatgattaaactggccctgtctgcagccagtggtttggcacacctgcatatggagattgtgggcactcaggggaagcctggaattgctcatcgagacttgaagtcaaagaacattctggtgaagaagaatggcatgtgtgccattgcagacctgggcctagctgtccgtcacgatgctgtcactgacaccatagacattgctccaaatcagagggtgggaaccaaacgatacatggctcctgaagtacttgacgagaccatcaacatgaagcactttgactccttcaagtgtgccgatatctacgccctcgggcttgtctattgggagattgctcggaggtgcaattctggaggagtccatgaagagtatcaactgccatattatgatttagtgccctctgacccttccattgaggaaatgcgaaaggtcgtctgtgaccagaagctacggcccaatgtccccaactggtggcagagttatgaggccttgcgagtgatggggaagatgatgcgggagtgctggtacgccaatggtgctgcccgcctgacagcgctgcgcatcaagaagactttgtcccagctaagcgtgcaggaagacgtgaagatttaagctgttcctctgcctacgcaaagaacctgggcagtgaggatgcctgcagccaccgtgcaagcgtggaggcctacctcttgtttctgcccagccctctggccagagccctggtctgcaagagggacagagcctgggagacgcacactccctactgggtttgagacagacactttttatatttacctcctgatggcatggagactctgagagcaaatcatgtagatgactcgatgccacaactcgcactgcgtgcagtgggaaggacagaaagcccagtgcatctggcatgttgccaggagtggtgatgggtgctgggctcgcctgggagcagcccccataccgtgttgtccactggactgcaggtttcctccagggaccagtcaactggcagatactgagaggaaccggaagtgtcctcccttttacctgtgggcagtcctgagccacgccatccccttctcatctggaggaccgcccctagagacacaacctgctgcctgtctgtccagccaagtgcgcatgtgccgaggtgtgtctcacattgtgcctggtccgtgcctcgcccgtgtgtgtgtgtgtgtgtgtgtgtatgtgtgtgtgtaggtgtgtgtgagtgtgtgtgttagtgtaggtgtgtgagagtgtgtgtgtaggtgtgtgagtgtgggtgtgtgagagtgtgtgtaggtgtatgtgagtgtgtaagtgtgtgtaggtgtgtgagtgtgtaggtgtgtgagtgtg

SEQ ID NO: 2606 - DNA, 613 bp, Rattus norvegicus
  Genbank Accession No. S77858
gcagcagccaagatgtgtgacttcaccgaggaccagaccgcagaattcaaggaggctttccagctgtttgaccgaacaggcgatggcaagatcctgtacagccagtgtggggatgtgatgcgggccctgggccagaaccctaccaacgccgaggtgctcaaggtcctggggaaccccaagagcgatgagatgaatgtgaaggtgctggactttgagcacttcctgcccatgctgcagactgtggccaagaacaaggaccaaggaacctacgaggattatgttgaaggccttcgtgtgtttgacaaagaagggaatggcactgtcatgggtgctgaaatccgtcatgtcctagtcacactgggggagaagatgacagaggaagaagtcgagatgctagtggcggggcatgaggacagcaacggttgcattaactatgaagagcttctccggatggtgctgaatggctgaggacatttacgtgtctcgagcctgctccttgcccagtgtgagattcctgtgtggccccagaggctccctaatcacagcaccttgcctgtctggtttcttttggatgatgtttgccttcaccaaataaaacttgctctctgtgctc

SEQ ID NO: 2607 - DNA, 1008 bp, Rattus norvegicus
  Genbank Accession No. S77900
  misc_feature (1)..(1008): n = a or c or g or t
acacccaaagccaagatgtccagcaagagagccaaggccaagaccaccaagaagaggccccagagcgctacgtccaatgtcttcgctatgtttgaccagtcccagatccaggagtttaaggaggccttcaacatgattgatcagaaccgtgatggcttcattgacaaggaggacctacatgacatgctggcctccctggggaagaaccccacggatgagnacctggagggtatgatgaacgaggccccgggacctatcaacttcaccatgttcctcactatgtttggggagaagctgaacggcacagaccccgaggacgtgatccgcaatgcctttgcctgctttgatgaggaagcctcagggttcatccacgaggaccacctgcgggagctgctcaccaccatgggcgaccgattcacggatgaggaggtggacgagatgtaccgtgagcgcattgataagaagggcaacttcaactatgtggagttcactcgcatcctcaagcacggcgccaaggacaaagacgactaggctcttcttagctgtcccaatgcctacaccccatcccagtcacctcctcaacaacacatacactctaccctccccatgaggagttagggtcccggctcccagggcaggaaatgagccattaagacgcacagggtgaggctaggggttccaccacggacccaggcactagaggaagggccacagtggggaggtgagccaagggtggggccagctagcaccaaagtgaaggaagccactgaagatggccaccctcagccatgccctcccattccagggctaccctgaggaagaaaacacccatgttctggtgttggacactaattcccagcatccccacaaaggtacacacccattcaccatgtcccttcagaggatgacagtctgcacttcacctatggagttgtcccagcacacccagaatgcatagagggacgctgcctgagggacaaattctctaatacaaggctgagcacaaaa

SEQ ID NO: 2608 - DNA, 3001 bp, Rattus norvegicus
  Genbank Accession No. S78556
cggcacgagtgttcttgccctcgtagccctctgtccagccgccatgataagcgccagcagagccgcggccgcgcgtctcgtgggcaccacagcgtcccggagtcccgccgccgcccgtcaccaggatggctggaatggccttagtcatgaggcttttagatttgtttcaagaagggattatgcgtcagaagcaatcaagggtgcagttgttggaattgatttgggtactactaactcctgtgtggctgttatggagggcaaacaagccaaggtcctggagaacgccgaaggtgccagaactaccccttctgtggttgcctttacaccagatggggagcgacttgttggtatgccagcaaaacgacaagctgtcaccaatccaaacaataccttctatgctacaaagcgtcttattggacgacgatatgatgaccctgaagtacagaaagacactaagaatgttccctttaaaattgtccgtgcctccaatggtgatgcctgggtggaggctcatggaaaactctattctccgagtcagattggagcgtttgtgttgatgaagatgaaagagactgcagaaaattacttgggccatacagcaaaaaatgctgtgatcacagtccctgcttatttcaatgactcacagcgacaggccactaaggatgctggccagatatctgggctaaatgtgctccgagtgatcaacgagcctacagctgcagctctggcttacggtctggacaaatccgaagacaaagtcattgctgtatatgatttaggtggaggaacctttgacatttctatcctggaaattcagaaaggagtgtttgaggtgaaatccaccaatggggacactttcttaggaggtgaagactttgaccaagctttgttacggcacattgtcaaggagttcaagagggagacaggggttgatttgaccaaagacaacatggcgcttcagagggttcgggaagctgctgagaaggctaaatgtgagctctcctcatctgtacagactgacatcaacttgccataccttacaatggatgcttctggaccaaagcatttgaatatgaagttgactcgagctcagtttgaaggcattgtcacagatctaatcaagagaactattgctccgtgtcagaaagctatgcaggatgcagaagtcagcaagagtgacataggagaagtgatcctggttggtggcatgacgaggatgcccaaggttcagcagactgtgcaagatctttttggcagagccccaagtaaagctgttaatcctgatgaggctgtagccattggagctgccattcaaggaggtgtgttggctggtgatgttacagatgtgctactcttggatgtcactcccctctctctaggtattgagacacttggaggtgtctttaccaagcttattaataggaacaccactattccaaccaaaaagagccaggtattttctactgctgctgatggacaaactcaagtagagattaaagtgtgtcagggggaaagagagatggccggagacaacaaacttctaggacagttcactttgattggaattcccccagcccctcgtggagtgcctcagattgaagttacatttgacattgatgccaatgggattgtgcacgtttctgccaaagataaagggacaggacgtgagcaacagattgtaatccagtcttctggtggattaagcaaagatgatattgaaaacatggttaaaaatgcagagaagtacgctgaagaagaccggaggaagaaggaacgtgttgaagcagttaatatggctgaaggaattattcatgacacagaaaccaagatggaagaattcaaggaccagttgcctgctgacgagtgcaacaagctaaaggaagagatttccaaaatgagagaactccttgctcgaaaggacagtgaaacaggagaaaacattaggcaggcggcatcttcccttcagcaggcatcattgaaactctttgaaatggcatataaaaagatggcatctgaacgggaaggttctggaagttctagcactggggaacagaaggaagatcagaaggaagagaaacagtaatagtggcagtgcattgtggagctaggacgacatactatgaagcttgggagtaaaggaacttcctgagcagaaaaggggcaaacttcagtctttttactgtatttttgcagtattctatatataatttccttaatatataaatccagtgacaatatataaatccagtgacaatagctataactcatttaatggtaataaagtcagcaatagcaggttcacacttctataactagcctgctgttttcagctgcacgtaaaggggtgggatggggctgtgtaccaatcattattaggtaaatctggtttgtgctgaagtagctatgttttcgagatggaagcccatttcacatgcagtagaggtaatctgtcatggaccttgaattgaggttcatatgcagatgcttgttgaccaagagcactgctataaatgacctgtgtgtacatttgctccttcaactgatgccttgcaagactaagctctctgtgtcatggtctataggtacagaagttaggtcaatggataacagctgtgttagccatagcttaaagtgatctatcaagaattatacaagcctctcatgggcctaaggcatacttctccagctaccctcttgggtggccaatgtctgacatctatattcttgatgattgttcctttttcatccattctggattttttttttttttaataaaattctgaaagcctcttgatctcctttgtgaatggtagtagctcaaggactatgactgtaccatcaggtttgtgagtagaggtaaaaaatcaacactggctaaaaggttgaacaaattaaacatggtgagggactaaataacatgttggcatgtatgctggatgtggaagcccactcaggaagcagtgtgaagccaggcggggctacacaatgagacaccccgtct

SEQ ID NO: 2609 - DNA, 867 bp, Rattus norvegicus
  Genbank Accession No. S79213
tggtagtggtttccgcgacaggcaggtgcgactgctttagcccggcctgggctccacggctgcctggagggtctctgcagtgcccaccccttctcctccgggaccccacgccagcagcgaccctgagccagcagccggagcgaccggcaatggcggcctcgacggcctcgcaccggcccatcaagggaatcctgaagaacaagacctctacgacttcctcggtggtggcctcggccgaacagccccgccggaccgtcgaagaggagctgagtaaaaagtctcagaagtgggatgaaatgaacatcctggcaacatatcatccagctgacaaagactacggcttgatgaagatagacgagccagacactccataccacaatatgataggtgatgatgaagatgtctgtagtgattcagaaggcaatgaagtcatgactccagagatcttagcgaaaaagttagctgctgctgagggctccgagccaaagtttcggactcgggaacaagaaagcagtggagaggaagacaatgacctctcccctgaagagcgagaaaagaagcggcagtttgaaatgaaaaggaagcttcattacaacgaaggactgaatattaaattagccagacagttaatttcaaaagacctacatgatgatgacgaagatgaagaaatgtcagagactgcagatgcagacagcatgaatattgaagagtcaaatcaaggatctactgcaggcgaccatctgcagcacaaatcacaaagttcataaacgtgttcatcagtgcagtcgttgtcaaatacaaaccttgttacttataccacactgcttcttgttctctacgactcgtgactatgtaccaaaatacaca

SEQ ID NO: 2610 - DNA, 515 bp, Rattus norvegicus
  Genbank Accession No. S79939
tgggggtgggggagggtggtgccttggagcctttgtgaggtcagtgccacacccactggcctcacatcctctcactgcccaggctgcctccctcctagtccagagagacaggagtgggcgatgggttcccgctgtgccaagctcagcaccggccacggcccggcccagaacacgggtcacagccgtggccacgagtcctccatgaagaaactcgtggcctgtgtgagtcaagacaacttctccctgtcatcagagggtgaggaagaggaggaggatgaggaagatgaggaggaggaagatgatgatgaggaagacgaggaggaggagcagatcccggtgaaaggcaagctgctgctgctggagcccgaaaagcaagatggtgctgaggatgctgtggcccagccaagcccggagcccaagcagaagcactcctgacccatcaaggcctgcccggcagtgggtgcccattgccatgccagaggaagaggacattcagaaaagaataaagagtctcc

SEQ ID NO: 2611 - DNA, 2760 bp, Rattus norvegicus
  Genbank Accession No. S98336
cgacccaaggacacctcggcctctgcagttgggggctggctctgaggacagaaagccttttgagacagccgcctcccacctgatgggcatgcaaagcgcagccaggcactgtccccaaggtcacctcaggggttgatagaggtgtccctcccaagcactctggctcgaatgcatataagcaggaccacccagaccctgccatgccaccatgcaggggccacacctctctctgctgctgctgctgctagcgactatgggggctgtgttacaggctgacacagttgaagaactgaccaataccaggggcctcatcttccttgaagatggggtctggcctcccagcagtccccctgagcctttgtgcctggtggcggtgagaggggaaggggacacaagcaaggcttccctgacggtggtggggggcctgcacagctatgagcatgccttcctggaggctgtccaagagtctcgctggggacctcaagacctagccaccttcggagtctgcagtactgactcccagactaccctgcctgcccttcagcgcctcggggcctggctcggagagactggggaacagcagttgctagtcctacatctggctgaaggtacgtgaaggacaacatctcaacacccttgttgccttgggactaacggaggctcctcccaaggtttgggcgggacctgtggagtgtggggggaaatccctaacttggttgccaaacagaaccttgtgggacacaccttgtgggagccgtagtctgcaagatggcagaacatcccatggtcacaccttcccagacagaagagctgtcacgtccctatctataagcaaggtcttcatacatgaccccagaagatccccggttagagtctgactgagggacttgagggacagatgctaatggcctcagagactcagctgtcaccaatatttgcagtgatatgggagcctcagctcttgctgaagttccaagagcctccacctgggggagccagccgctgggagcaagccctgttagtgctataccctggacctgggccccaggtcacagtcacaggagctggactgcagggcacacaggtaccagagactggcgtgggtcctctggttgggggttgggggagaagttgtgccagatgggaggattcctgggtgaggagtacaccttggagtctattcccagtctggcagggggtggtgcctgaccacttccccagtccagtccagtgagttcctgtatccacagagcctctgccctactcgggacacccgctatttggtgctgactgtgcactttccagcgggggcctggagcggctcggggctcgccctaacccttcaaccaagcaaagaaggtaggtcctggcagagaggaggggacagtgtggaaggaggctgcccttagcccttgccctcagccagcacgcgcccaccctctacaggtgccaccctgaccatcgctcagctgcaggcctttctgtttggctctgattcccgctgtttcacgcggatgactcccaccctagtgctgctgccacccaccgggccgacaccgcagccagcacatggccagctggacaccgtgcctttcccgcagcctgggtgcgcgcaaggacggaggaggaaatggggaggtgggaatgggtagagggtccaccacagcctcttgtgctcacagctggcccacttcgttctattccaggctgtccctggagcctgaggacctgccacacagtgctgaccccttcctagagaccctcactcgcttggttcgtgctctgcggggacctctgacccgggcctcgaacactcgtctggccctggaccctggtgcgctggccagcttcccacagggcctggtcaacctttcagaccccgtggcgctgggacgtctgctcgatggggaggaacccctattactgctgctgtcacccgctgcggccactgtgggggaacctatgcggctgcacagccccacatctgctccctgggcagcaggcctggcacgcagggtagcggtagagctgcaggcagcggcctcggagctgcgggacctcccaggcctgccacccacagcccccccattgctgtcgcgcctactggcgctgtgccccaacgactcccgcagcgccggggacccgctgcgagcgctgctgctgctgaaggcactgcagggcctgcgtgcagagtggcgagggcgggaagggcgcgggagggcggggcgcagcaaggggacagggacagatgggctgtgcgcgctgcgcgagctgagcgtggaccttcgagcagagcgctcagtgctcatcccggagacctaccaagccaacaactgccaaggcgcctgtgcatggccacagtcggaccgtaacccacggtacgggaaccacgtggtgctgctgctaaaaatgcaggcacgcggggccgccctgggtcgcctgccctgctgtgtgcccactgcctacaccggcaagctgctcatcagcctgtcggaggagcacatcagcgcgcaccacgtgcccaacatggtggctaccgaatgcggctgccggtgatgtccgccctaccccatcccccgtgtccccagtcagcgccccaataaagattagcaagcactcagctggggtgtctgtgggcggagagaactcctgacaacctcccttagcgaatgcaaggcgtgagtccttcccatacacccggtactcccctatgggagagctttcggtccctaccgcttttctgtgtagccctggctgtct

SEQ ID NO: 2612 - DNA, 70 bp, Rattus norvegicus
  Genbank Accession No. U01347
ggacagcctcccaccagcttcctggtctcaggccctgctacaccgggaaaccatggacattgaagcatac

SEQ ID NO: 2613 - DNA, 691 bp, Rattus norvegicus
  Genbank Accession No. U02534
cagtaacacagacagtgcaggggccctgggcaccctcaggttctgtgtgtttgggctgggctccagagcatacccgcacttctgtgcctttgctcgagcggtggacacaaggctggaggagctgggcggggagcgactgttgcagctgggccagggtgatgagctctgcggccaggaggaggctttccgaggctgggcccaggcagccttccaggctgcctgtgaaactttctgtgtgggagaagatgccaaggctgctgcccgagatatcttcagtcccaagcgcagctggaaacgccagaggtaccggctgagtacccaagctgagagcctccaattactgccaaggctgactcacgtgcacagacggaagatgttccaggctacaattctttctgtggagaacctacagagcagcaaatccacccgagccacaatcctggtgcgtctggacactggaagccaggagggactgcagtaccagccaggggaccacataggtgtgtgcccacccaaccggcctggcctagtggaggcgctgctgagccgagtggaggaccctccgccatccacagagcctgtggccgtggaacaactggaaaaaggcagccctggtggccctccccccggctgggtacgggacccccggcttcccccaggtaccgtgcgccaggctctcacttacttcctg

SEQ ID NO: 2614 - DNA, 1589 bp, Rattus norvegicus
  Genbank Accession No. U06230
aattggcttgaaaccagttgtagggggttcgaatcagaatctctcgatcactcaaattggctcctgattgcacttcgtgaagggaagattgaagttcagtttaagaatgagttttcaacccaaatcacaactggaggcaatgttattaacaatggtatatggaatatggtgtctgtggaagaattagacgacagtgttagcattaaaatagctaaggaggccgtgatgaatattaataaacttgggagtctttttaaacctaccgatggatttctggacaccaaaatatactttgcaggattacctcggaaggtggaaagtgcactcattaagccgattaatcctcgtctggatggatgtatacgaggctggaacttgatgaaacaaggagctttgggtgcaaaggaaatagttgaaggaaaacaaaataaacattgcttcctcactgtggagaagggctcctactaccctggttcaggaattgctcagttcagcatagactacaataatgtaactaatgcagaggattggcaaataaatgtgaccttgaatattcgcccgttcactggcactggggtcatgcttgctttagtttctggggacacagtgccctttgccttgtccttggtggattctggctctggaacttctcaggacattctggtatttgttgaaaattcagtagcagctcacttagaagccataactctgtgctcggaacagccatcccagctgaaatgtaacattaacagaaatggactggaactgtggaccccagttagaaaagacgtcatttactctaaagatctccaaaggcaactcgccatcttggacaaaacaatgaaaggaaccgtggccacttacctgggtggcgttccagatatttccttcagtgccacaccagtgaatgctttttacagcggctgcatggaagtgaacatcaacggggtacagttggatctggatgaagccatttccaaacataatgacattagagctcactcctgtccgtcagtgaggaaaatccagaagaacttctaaagtctgtttcctgggcttctaatctctcttttcatattgtaattatgctcttgttcatgtttccatcaccaaatggcaggattacatgtgttatatgcatgtttaaatatgatgtggtactttgtccttcagatttttgttatataagtcgcatttttgaaaagtcttgtactcactgctgtctagaaattaaataacaaaacacatgaaacatttaaatttcaatttatttcctataaatcttccagtgcgtcacaggcaacataatctgctccattgtctttggagagcgctttgactacagagaccgccagttcctgcgcttgctcgacctgttgtataggaccttttccctcataagctcattctccagccagatgtttgaggtctactctgacttcctgaagtactttcctggtgtccacagagaaatctacaaaaacctgaaggaagtcctcgactacattgatcatagtgtggagaaccacagggccactttggaccccaatgctccccgagactttatcgatactttccttctggaattc

SEQ ID NO: 2615 - DNA, 1812 bp, Rattus norvegicus
  Genbank Accession No. U17565
ctcagagatgaggagcagacagctgagagcattaagaaccaaatgacggtgaaggaatgggaaaaggtgtttgaaatgagtcaggaccaaaacctgtaccacaatctctgcactagcctcttccctacgatccacggcaatgatgaagtaaaacgtggcgtcttgctgatgctgttcggtggcgttcccaagacaacaggggaaggaacctctcttcgtggggatataaatgtttgcattgttggggatccaagtacagctaagagccagtttctcaagcatgtggatgagttcagtcccagagctgtgtataccagtggcaaggcctccagtgcttccggcttgacagcagctgtggtgagagatgaggaatctcacgagtttgtcatcgaggctggagcgttgatgctggctgataacggtgtctgttgcattgatgagtttgataagatggacatgcgggaccaagttgctattcacgaagctatggagcagcagaccatatctatcactaaagccggagtgaaggcaactctgaatgccaggacatccattttagctgcagcaaaccctgtcagcggacactacgacaggtcaaaatctctgaaacagaacatcaatctgtcagcgcccatcatgtcccgctttgacctcttcttcattttggtggatgagtgcaatgaggtgacagattatgctattgccaggcgcatagtagacttgcattcgaggatcgaagaatcgatagaccgggtttattcccttgatgatataagaaggtatcttctcttcgcccgacagtttaagcccaagatttccaaagagtcagaggacttcattgtggagcagtacaaacgcctccgccagagggatggctctgggatcaccaagtcgtcgtggagaatcactgtgagacagcttgagagcatgatccgactctcagaatcgatggcccgcatgcactgctgtgatgaggtccagcctaaacatgtgaaggaagcttttcgattactgaataaatcgatcatccgtgtagaaacgcctgacgtcaatctagatcaagaggaagagatccagatggagacggatgagggaccaggaggcatcaatggtcatgctgacagccctgcccctgtgaacgggttcaatggctctggtgaagatgccagtcaggagaccgttcccaagccctcccttaggttggcctttgctgaatactgccgaatctctaacctcatcgtgcttcacctcaggaaaatggaagaagaggaggatgagtcagccctaaagaggagcgagctggtcaactggtacctgaaggaaatcgagtcggaaatcgactctgaagaagagctcataaataagaagaggatcatagagaaggttgttcatcgtctcacacactacgatcacgttctgattgagctcacccaggctggactgaaaggctccagtgaaggaagcgagagctatgaggaagatccttacctggtagtcaacccgaactacttgcttgaagattgagatatagaaggtgacttacggccaggaaccgggggtggcctaccttagccgggacctgggcatgcactgagaccgtttctggagcgatgcttgggggacagttgagaagagacagctgaacagtgagtaatgccgtgatttcatgctggacatgcgtgggtactttgtgcttttcctacacatgaaataaaaagtatttcagaaaacatgattgggatccaacttcaacaggacaagacaaagtgcccacgcatgtgccagcattaaatccacggccatgaactcagc

SEQ ID NO: 2616 - DNA, 975 bp, Rattus norvegicus
  Genbank Accession No. U21718
ctgatcaacaacttcagggtgatgggaaaataattgataggagaccagaaaggcgaccacctcgtgaaagaagatttgaaaagccacttgaagaaaaaggtgaaggaggtgaattttcagttgatagaccgatcatcgaacggcctatccgaggccgaggtggtcttggaaggggtcgaggtggccgtggccgtggaatgggccgaggtgatggatttgattctcgtggcaagcgtgaatttgataggcatagtggaagtgatagatctggcctgaagcatgaggacaaacgtggaggtagcggatctcacaactggggaactgtcaaagatgaattaacagagtcacccaaatacattcagaaacaaatatcttataattgcagtgatttggagcaatcaaatgtgactagggaaacacctgaaggtgaagagcacccagtggcagacactgaaaataaggagaacgaagttgaagaggttaaggaagagggtccaaaagagatgactttggatgagtggaaagctattcaaaataaagaccgagcaaaagtagatttaatatccgaaaaccaaatgaaggtgctgatggacaatggaaaaagggatttgttctgcataaatcaaaagttgaagaggctcatgcggaagattcagttatggaccatcatttccggaagccagaaaatgatataacgtctcaactggagatcaatttggggagacctaggccgcccaggacgttgtgggagagagaggacgtcgtggacgtggccgtggtggtcgtcctaatcgtggcagcaggactgataagtcaagtgctttctgctcctgatgtagatggccccagaggcattcccccgctctggcctaactggatgccataatacaacactggttcctttgtggaccctcctgttcaaagcttttgcatgcttacttttgcatgcttaaggatcccaaacaactaagaatt

SEQ ID NO: 2617 - DNA, 428 bp, Rattus norvegicus
  Genbank Accession No. U21719
caccctaacctaaaccttttgaattttgaattaatgggtaccctatagaaaaaatgacctgcggaaaaccaaacagtgaagggaaagaaggaaagaattccaattgacacaatttaaataaaatatggcttttcaaataaaggaagagaagtttcttttgggcacacaatctaaacaatatttatgtataattcagctcttatttggcttaaatgggcttagtgggaaatgttatcatttttactattttctacagagaaaatattttccagtttatcaagtaactctggactttggaattacctgtttttatgttccagctgtctatatagttgtttctctgaaattgtacataaaatgtttttacattaaaatgaattactgtataaagtactgcattatgcataataaagatactaatgctttat

SEQ ID NO: 2618 - DNA, 597 bp, Rattus norvegicus
  Genbank Accession No. U21720
cccaaacccttgctagccagggactgacccctgcttcccacccccaggaccgcctgagccaggtgctacgggacctggaggatgagagcacccctattgtgaagctgggggatgccagcattgcagcacccttcacctccaagctttcctccatccagtgcatctgccacgtgatcaagcagggccgttgcacattggtgacaacgctgcagatgttcaagatcctggccctcaatgccctcatcttggcatacagccaaagtgtcctctacctggagggtgtcaagttcagcgacttccaggccaccctgcaggggctgctgctggccggctgcttcctctttatttcccgctccaagcctctcaagactctttcccgagagcggcccctgcccaacatcttcaacctatacaccatccttacggtgatgctgcagttctctgtccacttcctgagcctggtctacctgtaccgggaggcccaggcacgcagccctgagaagcaggaacagtttgtagacctgtacaaggagtttgagccgagcctggtcaacagcactgtgtacatcatggcatggcatgcagatggtacctttg

SEQ ID NO: 2619 - DNA, 175 bp, Rattus norvegicus
  Genbank Accession No. U25282
gtatgtgtccccctcccataagcctcaccaacactccccacccctgtctctttatgcccatctgcttctgcaaacaagaggattgttaggttcttaggaacacttgggctcagggcagaatgggagggacctgctggaccctcagatggatgtgtcctccctccctccctcccag

SEQ ID NO: 2620 - DNA, 643 bp, Rattus norvegicus
  Genbank Accession No. U26310
aacccccatgctagctgccaccattgttcacttcaaggtctctgcccaaggaatcacactgactgacaatcaaagaaagctcttcttcagacgacattaccccctcaacactgtcaccttctgtgacctggatccacaagaaaggaagtggatgaagacagagggaggtgcccctgctaagctcttcggcttcgtggcccggaagcagggcagcaccacagacaacgcttgccacctcttcgcagagcttgaccccaaccagcctgcgtctgccattgtcaacttcgtctccaaggtcatgctgagtgctggccaaaagagatgaacgaatcctggagcccttgcccaaggctggggcactggggacggggtgtgtggggagggatctgcgaatcctgaccaccttgaatccagaacgagggctttgggtcgaccgtggagaaggagagaagaaagtgcaatgctgggagagggaagtgaattgtggagggagggaggggaacaggaggaagaggaaggaaggaagaagagaggaactcgaaatcccctgtacagatggaagccacacctcccaaagcctctccagctagctggggcccctccccctcacctcccaaagcctctccagctagcatgggggttc

SEQ ID NO: 2621 - DNA, 1496 bp, Rattus norvegicus
  Genbank Accession No. U31668
gcgggggcagcagcaggcacgagaagagcctggggttgctcaccaccaagttcgtgtcgttgctgcaggaggcgcaggacggcgtcctggatctcaaagcggctgcagatactttggctgtgaggcaaaagcgaagaatttatgatatcaccaacgtcttagaaggaattgatctaattgaaaaaaaatcaaagaacagtatccagtggaagggtgtaggtgctggctgtaatactaaagaagttatagatagattaagatgtcttaaagctgaaattgaagatctagaattgaaggaaagagaacttgaccagcagaagttgtggctacagcaaagcatcaaaaacgtgatggaagactccattaataacagattttcttatgtaactcacgaagacatctgcagttgctttaatggtgatacactgttggccattcaggcaccctctggtacacagctggaagtacctattccagaaatgggacagaatggacaaaagaaataccagataaatctgaagagtcactcaggaccaatccatgtgctacttataaataaagagtccaactcatctaagccggtggtttttcctgtccccccacctgatgacctcacacaaccttcctcccagtcctcaacttcagtgactccaccgaaatccaccatggctgctcaaaacctgcccgagcagcatgtttctgaaagaagccagaatttccagcagacaccagctacagaaatatcttcaggatctattagtggagacatcattgatgaactgatgtcttctgacgtgtttcctctcttacggctgtctcctaccccagcagatgactacaactttaatttagatgataatgaaggagtttgtgatctgtttgatgttcagatactaaattattagattccacggaaacttgggactgttatctacctctaactgtaacattttagaattcttaataacctaagtatttaaaattatgaatgtaacacctttttagttcactgactctaaagtgttttcctaacattttacttttacttcacaaaacttgaaagggctctgactgcttcagggggggataattaactgtccaccagcatgcccctccagtgattacactcagtttcattcagtgctgaattctgtagcttcttcttagaggacagttacagcaggcttcagttcatcataacaaaacattgtccaaaagatcacttacttgtcttatgtttttactgccaaagctgtttctatgtatccttcaaacagacattcactgccatatataaagtgaaggatatcactgttgagtgaacagattttgtgaagtgccttctgttttagcactttaagtctatcagtttgttgattcagacactccactttcctagagtataggaaagatctgtttatgtagtttgtttttaaaatgtgccaatgcctgtacattaacaagatttaaagaaataaagttgtatgaaacattga

SEQ ID NO: 2622 - DNA, 618 bp, Rattus norvegicus
  Genbank Accession No. U47014
cccagaatgtatcgtaggggaatacagagacggaaagggagaaaattttaactgtaaaaaatgccatgagagctgcatggaatgcaagggtcccggcagcaaaaactgcactgggtgctcagctggcctgctgctgcaaatggatgacagccgctgcctccgttgctgcaatgcttcccacccccacagatcccaggactgctgtgactgccagagttccacagatgagtgcatccttccagccagcgacgacactgtgttccatgagcacaccaagactgctctgctggtgacctcaggcgccatgctgctgctgctgttgggggctgctgtggtcgtgtggcggaagtcccgaagccaacctgtggcaaaggggcgctacgaaaagctggcagaacccaccgtgtcatactcctcctacaggagcagctatctcgacgaggaccaggtgattgagtacagggaccgagactacgatgaagatgatgaggatgacatcgtctatatgggccaagatggcactgtttaccggaagttcaagtacgggctgctggatgaggcagaagatgatgagttggagtacgatgatgagagctactcttaccaataagaattccc

SEQ ID NO: 2623 - DNA, 5486 bp, Rattus norvegicus
  Genbank Accession No. U48828
ggtcattgggcttgaggatctccctcctgagggaagattctctctgagagtcttacatatgggggctcgtccgggatcggagatcctctgcctagagaccaccgaccacccaccgggaggtaagctggccagtgtttgtcttgtcctgtcttgtcttgctttgtgacttgttctgtaaatgcttagttacttggcttgggtctagaccgtttgtatttgggcgggccagagaaggagctgacgagctcggacttctcccccgcagccctggaagacgttccaagggtgtttagagcccggtttttcggggctcagcctgtatcggaaggatacgtggttttggtttggaggagagaggagagagccggatccactgaaggatccggacccttgtcgcctctgtctgaatttttggcttcagtttggacaaccaagcccgcggcgcgtctgtctgtctgactgttggaattggctggcttcttagggtcctaattttctttgaacatctggggaaattggttataggatgctttggcttggtcttgtttggcttggttggtttctgtgggattgtccaaggtcttcttggcttttgtttcggttttgggacttgggacaagacaactttgttttaaaatcttgggaactgacgaattgggtttaaaaatcaatgaaacttggtttgctttgtttgtcaaggagttttacttggtcctcttggtgcttaacttggaaataatttgcttgagaaaaattgttttctcccagggagttttatctttctctcttgagcctcctccccaaggagagatgcccctccctttgctccccttgtccattctagctgctgttaacagttgtgtatgaagaactccaggttagtgagtgaccctgtctgaagcaggtattaacaagagcctgaaagctttaccttagatcctgaagaaaaattctccctgttgcttaaacattcacagcttctaaggaagggacaacacagagtaggaaaatgtaggggctgagggtgacaagcatgcaggcctgctagcaagctgcaggctgcgcgtgggcagtggcgcagctcaggccaagtcagcgtaagaggagtttcaaggtgatgaggccggccgcctttgacaacaagaagataacgtagagttagtggtgttttatgagacttttggccctgaaaaaataataattccagttgctgccttcagtgaccagaccttcaacacttgctaacaaaaggagagtgttcattaagagaagttctttaagggagcctgccatatctgctgcccctattccaagagaggagttgatctccaacattaagtaaccttcccctgttagtcatcattgacatggagagtgcctttgatcctatccccacagcagccagttcctacccctgtggtcaaaatgccccaggttgggggacagagaagcccctaaaatagtttcaaaaagaatctgcaacaaactgtgaagaactttgttttgccagtcaaaatttagaattcaggctttggctgtggccaaggtcaggattaatgttttcttttccatgggcctttagcccactgagacagtttggtaaagggctgctactgaggtcctgaaagtcccaggtgaactggttacaattcttttgtcagccacttggcatctagcacccaggtcctagccatctctccatccttttgttattagttcttaagtccagagagatagtcggggtaacagatcagctccctctctgcttggcgttctgtttcacagacacaaagcttgtgcttatttttacaacagcctttttgtcccaaaaagtcctcctggtttagctgtgtgactaaatgctatttgtcctcttcagtggactctattctcaagattctcttgttttctcaccatcccatttgagatgcttgttagtaactgttacaggtcttctttacactgaggaaagacagaatcctactggaggcagaaagaatgttccagacatggatagaagaccctcactcctgactgttgacttgaatactcctgaaggtagggagtgctccaggtctgccaccaggctccaagggtgggtctccgaggggctggaaaatgccccaccaatctggctaagataagggaaagatataaagaaagaaagttacagaaatttgaagggttaagctaagttgctgagagttagtgtaagttgcagagaaagtaaagttgaagtgtagttacataagtgggcagcatctaatatctgtagaggaagatgcagaagatatgagagagagactgaggaagagaaagaggaaagaaggtaaaaagagcaggaagctaaggaagaaaagagaccaaaggaaaaagaagctagagagctaaagagggataaaagacaggagaggaatatatactggccacagtagttaggaaacctaggaagacagtacctggcaacagaagagaattcctagctaaagatcagtgtgcctatcgcaaggaaaaaggacactgggtcagggactgccccaggaagaacaagaagggcctctccagcaacccggaaggcaagcctcttggttctagagtgctggctatgcgctaagatagaagggaagccggcccagttgttttgtgaatacgggggcccaacactctgtgctcctacgcccaaatgggctagtgtcaagcaaaagaccttgagtacgggggttactgacaacaaatgatactcatggactacccgaagaacagtggaccttggcgtgggccgggtatcccacttgttccttgtgattccagactgcccctacgagtctaaaccctgcaaccctgctcccggaccctgacctagacaccccccttcatgactgtcaacaggagctcactaaagcacaggagtggcataaagatcggactgatcagccaacagagggggtagatgccatctggttcatagatgagacagctcttacagaagaaaaaagatgggctgggacaacagtggtagatagaaacagagtcatttgggctcaggccctaccagaaggacaccactactcagagggtagagctcgctcccctcaccaaagcccttgggctgagaaagagacttaacatctatgtggacagcacgtatgcctttgctacagcccatcagcagaggggcctgctgacatctgagggcaaggaaaaaagagattctggctatgttaaggaccctctatgacccagccaggccgaggaagagactctggtacacctcaacgagaaagaagatcctgctacaaaaacaggcagaggccatggtaaaacaaatacatcaatggactcacttaggggtaagcaaactcatccagacattttcaaaaactaaatattatgtcacagggtctcaagtatctcgtgggaacagatagtgcactgatgtataccaggccaaaaggtaactgttttcaggaaagttgacttgtggtatgaggctccgtgggggaacggcctggatactactgagaagtggacttcacagggataaaaccaggaaaatatggttataaatgtctcccagtgtttatagatatcttttcaggaataggtagagctttcccaccaagcaagagacggcctcaatagtcatcaagaagatactagtaatgtatcaagaagatcatagaagaaatcttctcccgatttggaatgcccaaggtaatctggtcactgacaacagtcctactttcgttgccaaggtaagccagggtgtaaccaaggtatttagaggttgattgaaaattacgttatatttacagacctcaaagttcaggacaggtaggaataaataaataaaattttaaagagaccctgaccaattgaccatggagactggcgtagactgggtgacactccttccctcttgcctctcttcagagcaagaaataccccttccagattcagctttaccccctttgagatcttatatggggcctcagctcccctgactatattaagatgatgttactgaaccaacatgtcatagtaataatgatttgtatgccaggctaaaagacctacaggtgatatagaagaatctgctcacagtgacagcagcctatgccccggggacccccgagacatgtcatcacttccaggttagagactacagctacactgagccagacactcgagctcgctagaaaggaccgtacctagtgctgctgaccacccgtcacagccatcaaggtctcagccctcaccagcagcgtactagctgttggggctgagagctgggacctagagggacatcagatcttcaaagctcctagacttaagtgattggaggtgctataatgcctattgaggagtgtgttttaggaacaagaatttcatgtttgcctgttttgccctgggttcccctcggaatagttgtaaggataggcttgatttttatgccatatgatgtgacattacatatgttgagtactcctaacacgtcttggggctgtccctcagggtcgcaacctatataagttttgaagttcttaaagaccttgatttatagttcagatagtttccagattagaatcctgattctaaagactttataaaaccccaaagagagttgagaattatttaaggctatctaggttccacaagggcagcacaaggacatcttcagtttccccgcaattccggaagagtgaagaaagactttttagctcacctccaagaatacctaacctccctctcagaggtagtccttccaaatagggaaagattagacctgatattccttaaaaaaggagtctgtgttctacactaaaaaagaaatgttgtttccaaacaggtcaggccataattattagagatagagtctttcagtcaatccaacttttgttctgagcccacagtatcagatggtggaaaaaaaaaaaaacagaggtacctaaaacaagttgagtggaagattccactcaaggacaaaaagaaaatgggggaatgaaagaccctctcccagaaagggaattgtacaagccccaaggccctcaactatagaagtaataaataagtgttagatatgtggggcaagctgacccatcatttaggcggaacaggccagaaaaggaaccccaaatgcagaaaccagactaaattatgggccctgctccatgggccacctggcaggaaaaagaaaaagtccctgaccccccggaagccctgaccaccatgtactttttgctaactcactgttatgattatagcccaaataggtaacatacacgtatgcctcatttactccaccaatcacatccctgtaaccattcatctgcttctgtaagcctgcttctgctcccccaaatactataaaaagcccaccctggctctgctaggcgcgccagtctttcaaattgactgggacgcccacagatatctgtgtatcctgatcaataaaaatcctcttgcagattgcaaaaaaaaaaaaa

SEQ ID NO: 2624 - DNA, 2006 bp, Rattus norvegicus
  Genbank Accession No. U53184
gcgcgcgcggccagcgagacctcccggctccactggcggcgcgggcggcggtaaaatgtcggctccaggaccttaccaagcagctgcaggcccttctgtaatgcctactgcacccccaacctatgaagaaacagtgggtgtcaacagttactacccaacgcccccagcacctcagccgggaccagccacagggctcattacgggcccggatgggaagggcatgaatccaccttcgtactacacccagcccgtgcctgtccccaacgccaacgcaattgcagtgcagacggtttatgtgcagcagcccatctccttctacgaccgccccatccagatgtgctgtccttcctgcaacaagatgatcgtgacccagttgtcctacaatgcaggagccctcacctggctctcctgtggcagtctgtgtctgctgggatgcgtcgctggctgctgcttcattccgttttgcgtggacgccctgcaggatgtggaccattactgccccaactgcaaagcgctcctgggcacctacaaacgtttgtaggactcggccagccacaggggaggtagacaagtgctcccggaagtcacccaacccttgcccagcgcagccagaagacgtcccttccttgatctcttcatgagctcgtcttcgtgtcttttagggggtggggaaagtcggaaaagtaacaaacccccaaacccagaaactgctgctggagttgtgccctgcacatgcaaagacgtggaccttgggtgttgctttaagggtttaccgcctgatctcgttaccccactaactgtgattgttactccatttgcatctcgtctgctgatttgccactgcctgccccctcttcctcaagaagaggccttcctggtgccaggctcaaaacccgaagctacagtttgccttatttttcactgtttggcttgatctgtaccatctctcccagccctaatgacagagaccttgccttaaagactttgcggttctgtaattgcagacttctccagcactcagaatcactttcaattccatagagttgttcctctccacacacacccctcccccggtgcacagaagggctgccgacacccaccagactcatacagagaaggtcacaagtactaaatgaaaggctcccagcccaccttgtctcagcccctgtcctgtgaagggactccttcctcacacagtttctgtgacttccttttgttcttaaacacatggaagttacttggcagggagacatttctagaataatttttgtgatcacgatacacccttcattctccgtttgctggtatgtttttagttggtttggttttagttttccacatacagtctagctcgtggccagccttgagctccgaggagatcctccatcttctcctctcaaatacccagggcccagacatttgcctctgcacctgctgggctttttctctcatttttccttaaccagaaaaacaaacgggtaatttcatcgactgcctatgtaggtttggtgtggttttgaaaaccttgtttccatggggccctttgggggagtcagggggcccctgcacgagcccatgcttcaatgccgagagattggctgctggaaccccctgaagcatgatttcatgttttagagatgagcttctgtggtacggtcatcatggtctccaacatcaacagacaaggtagaaggatgtcaacgacaaagataagttcagggctctttctagggtcaccactctgtcctgtgtaacactgacacagtctggccagcctttcaggaggtcctggctccctcctaaacccatgtaggwcttgctgcaagtaacagtgtatgaagtcaacctgacctggaacagaagtctgcatattggttaagatacagcctatgtatcttcatacaacgatccagaagtactagacatcatttttgcagtgaattatgggtaccatacatgactttgatgatatctgcttttaaacaaataaaatctttgatcactca

SEQ ID NO: 2625 - DNA, 1619 bp, Rattus norvegicus
  Genbank Accession No. U61729
ccaacacgttcatggtccttgccccgaaccttccagcagcagcctccgccgccgccccgtgacgcctgctccccgtcgtctgccgagccccgcgccatgactgtcgtctccgttccacagcgagatctcgctctgggcggccgctagcgccgttgggttcctcggggccctcccgatggtgagcccggccccgccgcccttgccgcgccttccggacccgcgcgctctgccacccaccctcttcctgccgcacttcctcggaggggacgggccgtgcctcgcccgcgcctcgcaccgctgcaccgtccagctgcagcttggtcccggccgctgccccacggcagcgcccaagaagcggcggaagaaaaaggtgcgggccagcccggccgggcagctcccaagccgcttccaccagtttcagcagcaccggccgagcctggagggtggccgcagcccggtgccggggccgatcgcagcgcaggaggagcggggtccaggggccactgccctgctatacagacagcccccactcgcgaaggaggttttaaaatcaaagatgggaaaatcggagaaaatttcccctccccatagccagcttgtgcatggtatacacttgtgtgaacaaccaaagataagcagacagaaaagcaaatttaacttgccactaaccaagatcacctctgcaaaaaggaatgaaaatgacttttggcaagattccgcttcctctgatagaatgcagaagcaggaaaaaaagcctctgaaaaatactgagaacattaagaataaccatttgaagaaatcagcatttctaacagaagggagccaaaaggaaaattacgccggagccaagttcagcgacccaccgtcccctagtgtcctcccaaagcctccgagtcactggatgggaagtaccactgagaatcccagccagagccgggagctgatggcagtgcacttgaaaacgctcctcaaagtgcagacctaggctccagtctgcagtgtgtattagacacagattcccccccatcctcggactgaaggaagtggatacggcagtggaaatttgccgtatcgcagcatccgacacaatgagcttatgtcacacaagcagcttgtattatattttgtattttgtaaatactgtataccatgtattatgtgtatattgttcatacttgagaggtacattatagttttgttatgaaagtatgtattttccctgcggatgtggtgggtgttttgtatatatacagtggagatattttaagtgggtgctaaggcacgtggaagactgtttatttgcacaggtactgacatttttttaagaacagctgtcaaatctcaaaagtgaagatctaaatgtgaacagtttacctaatgtactactgaagcttaagtctggcacaatcactgtaaacatggagtttgtgtttctctaaattgacttgacttttaatctgtaattactagaaagcttcctatttttaccaaacttgacttctggatatcagtatattgccattattgaaaagatttaaaacacctctaattttaaataccaacaaaattggttgtaatcaaattttaaatcaataataatttggcctcccccccttaaa

SEQ ID NO: 2626 - DNA, 339 bp, Rattus norvegicus
  Genbank Accession No. U64705
cggagaaaatgcatgccagggacttcacagtttctgctctggtaagagttgttggatttagtaatgctaattatagccattaagcaggattttactacaatatggctgctcagtgctgtgttgtcgttccccctgctcagaacaattgtttcttaactatacctgtctgctgtctacctgtagcagccagggacgcttggtctcatacatgatagaaagaaattaaatgaatgcctgacctgaatagggattgctgaattgagttgttgtatttgcagcatggtgacatggaccagaaggaaagagatgtcatcatgagggaattccgatcagggtcaa

SEQ ID NO: 2627 - DNA, 13894 bp, Rattus norvegicus
  Genbank Accession No. U68562
ctttgggtcacccaggaactgtatgaagttgcaattgagaaaatgcctttattagattggcccacaggagagctgatggtacagaatctgaatgatggatgtaggaagcatctctgggtcatgccacccctgggtaggtggcagtgggctgtgtaagaaagcaggctgagaagggtgcaagctgtaacagcctaggtccatgctctttgctttagcccctgcccatggtttcctgtaagtttccttgaagttgagataaactttcttctcagagtagctcttgctcagcagttatcacaggaatagaatataaactaagacagtacctaagtgtaagtccccattcatctatgtaataatgccaaattcatcctgaaagatcatttacctagaaatccattatttctcataactctttaactctgtagcttacttgaaggaaaagcaccttaaattaccagactgtccactcatttatattatttatttggaaatgtttgtaacagtacagtgaaactaaatttcagagacaatggctgtcagtttaggcatcatccgtttattataaaagggaggcatggaaattatttacatgatgaaatagttcagaatatcagtggaatgggcagcttcatgtgacaccatttcaacagtgatttcagtcgacatactttccaagaatgtcgccatctctaaataagaagtaatcctgtgaataaagagaccactgattaagatagtaataacaaatataaactgattttttttttggttcttttttttttttttcggagctggggaccgaacccagggccttgcacttcctaggcaagccctctaccactgagctaaatccccagcccctaaactgattttaaatcattagctttacttaccttgtcgtctagtactactttggtgcctccgtgttctgggagaagaactttatctccaactttcacactgacaggctgaatctctccaccctgatgaaaacagacacttgttagcaaagatgtatgtcttgttcactagatacacattaaagtttttgtttcagtatgtacaccaggagcctcctgcctcaggtttgtgttaattataggcattaatcacattaaaactgtaacttttaagtcactaaatttgtaaaagtgctcaaaccagtatctggcaggtacctaattagtggttaagcaatatagaccttacctacattaaatgtagaccttcataatatagcatcactgtagttactatatgacagagatgccttcagtgggcagctaaggttggctaactttttactgttaaatattaacacaccgtaagaccaagggaagggaagtaaagcaggtacttgttacactagacagcaaatggtcatgtatgacttcgaacaaatcgaaaaaattggcattacttttctccatttaatatacatttattgacttaatgtccttgttgtcaagacacagacttggtcagagactgaaggagaatgtccactcccccatactctagcggtttagttaagtgaagaacacccagagtagttcacctcctttctcaagtaggccaactaaaactcgaaatggtgtaggatgatttcagtgtctgggctaagccaacagtcaggctcctccacccatcaccgcacccttgcttttggggaacgggagtggggtgatggggtctatgtaaaaactgactggccattaattctggatccccctcactcagcactgtacctgtgctagaattagttttgtgccttattaaatacctcctccttcaattctgaaaagacccctgggtttatctacttgtatgactctttctgtctatttaaaatttgaagagtaggctacaaaataactacagaggtatttctttttttttttcagagctggggaccgaacccagggccttgcgcttgctaggcaaggcctctaccactgagctaaatccccaacccactacagaggtatttcattttgtgaggttttgttttactttgagatatggtctcgtcctgtacctcctgttggcctacaaggctctataatccacttgccttggcctccaaagaacctgggttagaggcatgaggcactatcaaggcaggcactttttaatctgtagtgtggggcactgctgaattagctcagtgggtaaagagacttgctatcaaagtatgggaacccaagttgccatcccaacactatagtaaaaaggatgtaacccccaacatgctcaggccagaaaccagactagttcaacacgactttaccccaaaagagtaaggtggagatggccctgcaacacatcatacagacatgtgcacatacagtcataccactcaaataccctctgcctttttacagtccctgtcattccttagaaatataaaacattctaaaattgttttcctgaatgcgaggttcttcgtgaattgaaatctaacttgaaattacttccaaaaaaaccttgccatttttaattaactttttaattaacaaaccaattcctcctccttcccacatcacataaaattctgtaccactctaggagctccgggttacacctttcctttcccgcctgatcccacagccacgaccgttgcttgcaatacttttccttgagacttttctggaagcataatgccacctttggtcacagtttcagcggcactcctttcaaccaatactctgtcaaatagcggaagaaacttcctaaaagcttgtccagcctgtggagagaaatgtgttcaaacagacagtaattaagttcgaagtgtcaggagacgagttaattaaataccactgcaaaccttaacattaatagtcgaaagccttccaaaatgaacagaaaacttaagtgtatctttagaatatagcccttcaatgttcactccatatagccagttgattttcatttccttgtctgttgtgagtgtgtgggggccgggggtcttcattcgctcatcagcaatcgcaaccttggtctttctccaaggtcaaatatttttcctttctcagatttttttttcaaactcgagtaacaggggagtggtgtcaatttttaagcccgatcttactctttctccaacataggactcattcacctaggctgtgccagggcaggtgggcttctgagtatgtacccgggcgcccgccccctgctccagacgcctgccgcacacgtgcgtgcagaaaagccgtggtggagaaagggtcggataggcctcgcttctgtagagcaacggaggtcgctggacactgagtgacccctgtcctgtcctgctagtcccaaagcgcacatggatccgtcggcctgccagccacgagcactcaccatgacttacgccgccgcagctccggactctgcactcggactcctgctgcaaggagactcccgtgggccggctcaggacacgtgaaaagacagcgcagcgcgcaggcgcactcagccccttagcgtgagagaaggcggccactccagcgcgcgcgccgattggtggccaggactccgcgcaggcggccgatgcgggtagccggaggcggaagaaaaggggagcactttctaggcttttccaggtcggccgctgaggtgaaagaacaagcccctcccggaaatgacgccacttgacctttcacccacgaaaagcgcggggccttccggaaggttctagaaccgagcgcggcccaggaaccagtgtacggcggcgggagagtgctgaggccacggggctgaggccgctcaggtaaggagggcggggccgcgcgcgtcgcatgcagattgcagggccggggcgtgggagaagtggggcgcgcgcgcgcgcacgcggggcgcggggcggggccggggagggaggggactcgggctcattgcggtgcgcgcccagtgctgggtccctcactcgccgcagacggcctgcctcgcctcgtgctcttccgccgccgccccgcaggtacgcggcctcggcgtgcacggcggcccggtgctcgtgggcctgcttgcagcgcggaccgagcacggagggctggggataagtctgtcagcgacgcgcaggctcggttcacttgttcaggcccagtagggccatactgctttcatcacgtgcggcgggcaccacgcgacctaggctaagcgcgggagcaagggcgggctagggtgggagcaacttgggccctgtggttccatctgcgcctggcgactgtagggctctatcggagggtggtcgcggtcctctagtcgctgtggccgcggtgatccggcgccttcactttgaccttgctcggggctcctggtcgagaagacacgtggggctcggcgcgtgcgctgagctagggcccttttctccggccttgcttgctgctgtgctactgtagctccgggtggatgctggcgggcacactctccttagagggttttgcaccgtcattagtacttctgtgattctctaggcacttgcatttagaacctgcctgcttacaccaactttttttttcagacacttttcggagtggatctgcttccaaggccgttttggcagtgaaagattaactcgagagggcaggagggggtggccatggggaggtggtttcgtgtgctttgtgctagtgctgtaggtcaggcatgggggcagcctccatgatcagttggttaacagattatgtcctgaatctgcagcgccgttagcagagaacagcagaactccaatctagccaccatattttgaagcaccgttggacaagtttgtagtgatactttttttctttccccagaaatgcttcgactacccacagtccttcgccagatgagaccagtgtctcgggcactggctcctcatctcactcgggcctatgccaaagatgtaaaatttggtgcggatgctcgagccttaatgcttcaaggtgtagaccttttagccgatgctgtagctgttacaatggggccaaaggtaccagtatacttatgtcgtgttaaagaatagtgttctgtagctgcaagacagcattttgtaatcgagttttgtgagtatctgatttgcatgtggtacaacttagtggtttggggggtgttatttaggtttgttagttggtcattctacgacggtgtccttactgctgcttcagtcgatttgggagacttctgtgcgttgtgatgtaatagtaacagctcaaggaagattttcaaaccagagtcatgactgtgtgcatgcttgcattaaattttggatcccatcccagtagttagagggtatatagaggggaaagtacaactccactctaataactcaagtgcatagctgtaatgtgagcgttcactgaacgctgaaatttccaacataaaaggcaaatgcactagtgtagaatcattactttaaaggtgtcgtatttttatatgcattttattctgcctgcatttatgtctctgccagggtgccaaggttctgggaactgacttccccctttggaagaggagcctgtactattaccaccaagcctgtctttacttaactttatgagctttgttgtttgggtcttttgtttgttttattcaagatgcatttctctggtagcctaggctgtcctggaactcaaagagatcatctacctgcttctgcaacacattgtcagactctttttacttgccctttgggaaaaactttgtggtctcccattcatctctacattgtacatacctcatgtttctgcaattatcacattgcaaagatttgtctagttttgggtttttgagtctcactagtttagtctggcttctaacgcccgtggcaaggctatcctcacatctccagcgtaggaattcagtattctactcacccagtgtgtttttattatgacaaggtctctaaccatagctggccaagtcagccttgaacttgagcactgctaagatcagaggctgggatcacacatttaagtggctgaatagggagctatagtactttgaggacatcattggatacagtgaggtcattttaaattgatactagactgaactgcataatcccagcattcaggaggctcaggcaggtggatctgaaagccatggatctaaagctataagagaaatcctgtcttgaaaaacaaaacaacaaaaagccctgcatctttaagtactgtttacatagctcaagacagaatagaagcttggttcaaatccaaaagttgccaataccgtcgttgccatatttgaagtttttattgagtgaaccagaagagcccatatttatcttactggctgatatttagtgaatgaattttaaagcaaaacatgtttttgataagcagggcattagtgagtggttcttgcctctggtcccagccttcaggaggcagaggcaagtagatctttgtgctttgtgagtttgaggacagccatggctgcacacagaagaaccctgtctcagaaaacaaagccagttcatagccaaactcaagtacaaacgatgtgaagaatgtcctgggatctgtgttttcttgttttataggtagcatctgttagttccagggaattcctgttgtgcctcagtcaaagttagactccagggcacatgagtagtgttcattttgtctatacacctaagatggttgattaacttggctttgaggttcgtgttgcaggattgttaacaatgacaacttcaaggattatctttaagggttgatattttttttttttgtcactatagggaagaacagtgattattgaacagagttggggaagtcccaaagtaacaaaagatggggtcactgttgcaaagtcaattgatttaaaggataaatacaaaaatatcggagctaagcttgttcaggatgttgccaataacacaaatgaagaggctggggatggcaccaccactgccactgttctggcaccgtctattgccaaggagggctttgagaagatcagcaaaggggctaatccagtggaaatccggagaggtaagagtttgtccttgatcctatgctgtaaagaattctacatcttcatctttgtcctttttgttgtagagtttgtgtatgttcttggtagagttgcccttccttacttatgtggatttccaagattgaactgaggccttcaggcttgtgggtccagtacttttactccctagacctatcttccacaccttgttttttaacttatttaatggaagtgaaaatacagggctttcggtatatccctggctgtcctggacacgcttggtaactttgtagacctggctagttagcttcaaatagatctgactgcttctcctttctgagtgctggggttaaatgtgggcactaccacccatgcccaaggccctgtagtattacttaacctttgatccatcccgtgagccctaagtagtgagaattctgaaactatcttttcttgttttgattaggtctcctttttagccttccctgacatggttccctatataatccatgcaggtctcaaatttttagccattctgtctcagtctcttgggtcctcggattacatgtgtgagccaccatgcaacatctaggtcaagcttttcaaaatgttggttttcagtctaaatgattgattgaatgcatactgttgtttggtgcagttgggagagtgctgacatgagaggttgcatgtgatcgttagaaggaatctgtaattcttagcggggaccatgataagcattgtagtaacatacattcttgaactaggtgtgatgttggctgttgatgctgtaattgctgaacttaagaaacaatctaaacctgtgacaacccctgaagaaattgctcaggtaaggattttatttcgtgttgaaaagaataattttgatcttttggttccaagaacaggatttgggtttgtctttgtagccatgactatcctggaattaaacgtatagatcaggctgaccttgaactcaaattcctctgcttccaaagtgcttgccccatcactgttagatcttactctttttagttttacggtgctgtaaataaaatttgtgttatttgtgaaaatattcttaggtgatatcaatgtaccctgtactatatgggttcaaacctagtccttgaagcatagttaacaagtgttttttatatgtatgtgcctgggtgttgtgtgggttgcaccatatgcatgcatgaacccataagaagaattaagagacagttgccagccactctggtgtaggtgctggcccgaacagtaagtcatcttaaccactgaggcatctctccacctctttagttttagtttattcttaatgtgtcagataatggaggaatgagggtgtagctccatttaaaactaacaactggccctcttgctctcttccttgctctgtccccttgctcctttccccttctctccagtcccctccccactccccacgtgctcatggtcggctctacctttcttctgcctttttctgtctttactacccatcctcatgccctaaataatcaattctattttaaaaaaaaaactattaactgtaaaataatcagtttagagtgtcaaaggagaagaaagttgaaaatattaatcttaccatttgattttgaagtaaattggttatttcaggttgctacaatttctgcaaacggagacaaagacattgggaacatcatttctgatgcaatgaagaaggttggaagaaagggtgtcatcacagtgaaggcaagcatgggatttgatatgttttgataatatcttcaatggggtgtctgtaacctattttccaaataaaaacttgaatctcttgtttgtgtcagtacaattcattcctttgtcttaacatctgtattgagtatatgctcactattagtctgaatatttgccccctacaatgagttcatctaacttaaataattagctctctgctagctgtaaatagaatggagcctctaatcctggctgtctgggaactctaggcttcaaccttagagagatggcatccctctgtcatctcttctttctgaagattaaaaaaggcatgggttcctgagctcaactttagttagtggcttgaatttttgtgggagtgcagttagaggacactgcagcatttccatgttgagtcccttatgcctgtgtcatctcttgctaatttggtatgtaatttcaaatgttggcttatgtttttgagacagggtctcattgtgtagtcatgtttttgagacagggtctcactgtatagatagtccaaattaggcttgtgtttcttttaagagattttttctatctatgagtgtttgtttgcacatgtatgtgcaccttggagtccagaagaaacagcagaatcctaggaactgagttgagaaccatcatgtaggtgcacaaaacccaattttattcaagaaaagcaaatggggctggaaagctggatggctcagtgattaagaacactggttgctcttccagagaccatgagttcaatctctagcaaccacatggtggctcacagcaacctaaaacgggatatagtgccctggtctggcacacaggtgtatatgctgataagagtatgtaaaatatataaaataagtatatctttagaaaaaaaagagaatagcaaatgttcttaacccttgagccatctttaggtttagctgaccaagttttgtttctttagtttaaataggatggaaaaaccctgaatgatgagctagaaattattgaaggcatgaagtttgatagaggatatatttccccatattttattaacacatcaaaaggtaagagcccatccacaagtgaaagtcgtcacaatatgctctaagctgctaacttactgtcagctgtgggtaatgggtatggctgatgcaataagtaaaaactgtgatgtttaaacattaatggtttggtaaatgaagaagaacatgagttactggtctcattgtggaagtaaattgttttactgctcattgtatttataggtcaaaaatgtgaattccaagatgcctatgttttgttgagtgaaaagaaaatttctagtgttcagtccattgtacctgctcttgaaattgccaatgctcaccggaagcccttggtcataattgctgaagatgttgatggagaagctcttagcacactggttttgaacaggtaatagataaattggattgggtttatatatttttagatagaaggtaatttctttcttttgcttttttgaaattccacattttgcttgtgtgtctcaaagctgtagtatatatgatgtagtgctctatgcattatgagtctatctctagctggtctcaaatgcacataattcttgagcctgtgcctcccacagcttcccagagaaaactatacatatgtcttttttttttttgtaagatttattatatataattacacaagggagcatcagatcttattacagatggttgtgagccaccatgtggttgctgggatttgaactcaggacctctggaagagcagtcagttttctcaaccaactgagccatctctccagctctacatatgtctttttttctttttttttctttctctccttttctctcctttttttcggagctggggattgaacccagggccttgcacttgctaggcaagtgctctaccactgagataaatccccaacccctcacacatgtctttttaacactggtgtgcttagcactaatgcccaactgtgtctggcaatgtaagagcagcatttctttaagaagggaatcaggttgaaacaaatttagatgagtagaggtccccatctcatcttttttaagaccagaagttgaaggaaaagagtagggtctgtacagtcatgtagacctagaacttaccagggactaaactagatgctttttcccaattccccctttggtttacatcttacgcagttaaatgtctttacaggctaaaagttggtcttcaggttgtagcagtcaaagctccagggtttggggacaacaggaagaaccagcttaaagatatggctatcgctactggtggtgcggtaagtaaaccttgtcatactgctttgctcagtgttgtttatgcttccagatcgtaaatacaatgtatacttcacaatagatgggctgtttctttctattggatatttggaacacgggttggattaaggtctcacttctaacttactgagcctggcctgagaatggacatgattaaaagttcttctcaaaatttaaaactaatttgtgtaagtgattttatttagactttgttctgatataccagtggaaaaatagcatttctttctctggatttttaagctttatgtatatgggtgtttgtctgcatgttttgtatgatgtatacataccagaaggcattttatccagttccatagcactacagttatagacagttgtaagctgccatatggatgctgggatttgaactcaggacacctgaaagagtagaatagctctccagtgcttgtgactgctgagacatctcactagccctgaaaagctgtttttcacaaaaatatttgtgactatagtaataaacctagtataatggaagccactaacagcacattgtttttataggtgtttggagaagagggtttgaatctaaatcttgaagatgttcaagctcatgatttaggaaaagttggagaggtcatcgtcaccaaagatgatgccatgcttttgaaaggaaaaggtgacaaagctcacattgaaaaacgtattcaagaaatcactgagcagctagacatcacaactagtgaatatgagaaggaaaagctgaacgagcgacttgctaaactctcagatggagtagctgtgttgaaggtaagactgacttgcaggtaaacattttaggctgagtctggtgatagtggttctttagtatttaccaatagtaactaagtgacctttccccaaatctttagtttttgttgctcgtttgttttggtttttgcatgtgctataaccaactttccatggggcacatgtaaagggacaactttcagcagttggtcatctacctttgcagtgatttttagaagcaagcaagccctttgacccacttgggtcatatccttaggccttctgagtcatcaataggcatctatcccctactggtattatgcatgagaccgaaaccattcttgtgctgtgtcatgcaaacagtctatcactgcccagtttcccagcttccttttctctttttctctgtgtagccctgactgtctcggaactcactctgttaactctgtagacaggattttcagtcctagaactcacttagtagaccaagctagctttgaactgaaaatcgctgcctttgcctcccaagtgctgggattaaaggggtgtgcacttctgcttggctagcatcctattctcacagggcagtacagcttgtgttgtaggaagttttgatagggggatacattataacctattactctagaattgcttccttctttgtttttgttttgaactctgctgtcacccaggcaggcctccgttggtataacccacctgccttaccctctcaagtgctggggtcgttactatgacactatacccagctcaggtctgccatccaggtggcttcaagtaatcattgactgggaagggtcggtactacctggaattttttatttaatctttaggttggagggacaagtgatgttgaagtgaatgagaagaaagacagagttacagatgctctcaatgctacaagagcagctgttgaagaaggcattgttctaggagggggctgtgctctacttcggtgcatcccagccttggattcattaaagcctgctaatgaagatcagaagataggtaaagattctttcaaatgagtttgtggccagagaggtaattagcaatgcaccacactttacaggggattgtttcacctatggtaggattggatgtctgattgcttactaaacttttatctttataattattttatgtgtgtgtgggagtgcattttgctctcatgtctcgtgtgctgtgtgtttgcagtattctgaggggctggaaagatggctcagtggttaagagcactgactgctcttccagaggtcctgagttcaattcccagcaaccacatggtggttcacagccatctgtgatgagatctgatgccctcttgtgtgtgtctgaagacagctgtagtgttgttatatataataagtaaatttgaaaaaaaaagaaatgcagtattctgagggccagatggggtcatcagatagcttggaactggagttacattggtgctaaggattaaaccaggtcctctgaaaaagaaaccattaaccattgagccatctttggttccccaaaaagggaaaacaaaagtaagttcatgaaaatgtgtttgctttgtaggtatagaaattattaaaagagcacttaaaattcctgcaatgacgattgctaagaatgcaggtgttgaaggatctttgatagttgaaaaaattctgcagagttcctcagaggttggctatgatgccatgcttggagattttgtgaacatggtggaaaagggaatcattgatccaacaaaggtaaataaatcagcatttctaaacaatgaatgacttgctctctggtgtatggttttctttaatttttttctttttttcggagctggggaccgaacccggggccttgcctagcaagcgctctaccactgagctaaatccccaacccctttctttaatttttaattgttttactaaatttttttctaggttgtaagaactgctttactggatgctgctggggtggcctccctgctaactacagccgaagctgtagtgacagaaattcctaaagaagagaaggaccctggaatgggtgcaatgggtggaatgggagggggtatgggaggtggcatgttctaactc

SEQ ID NO: 2628 - DNA, 206 bp, Rattus norvegicus
  Genbank Accession No. U70270
cccctccgctccagactccaagctcctgctcccagcctactgacctagctctccccagcctgctctgtgatattgtcacatatgctgacctcctctcttctgcagattcctacacacacaacaacgtgtgagggaggaagaagaaagatgttttggggagtgactttctttttagatactgtacagtaagttggtcagaataaaag

SEQ ID NO: 2629 - DNA, 1142 bp, Rattus norvegicus
  Genbank Accession No. U72660
ctgggcggcccgggcggccgcaccatggatcccggcaccgaggagtacgagctcaacggcgacctgcgccctggctctcccggttcccccgacgcctcgccaccccgctggggtttgaggaaccggcccatcaatgtaaaccattacgccaacaagaagagcgccgcggagagcatgctggacatcgcactgctcatggccaacgcgtcgcagctcaaggccgtggtggagcagggcaatgagttcgccttcttcgtgcccctcgtggtgctcatctccatctctctcgtgctgcagatcggagtgggcgtgctgctcatcttcctggtcaagtatgacctcaacaacccagccaagcacgccaagctggacttccttaacaacctggccacggggctggttttcatcatcgtggtggtcaacatcttcattacggcctttggagtccagaagcctgtcatggacgtggcaccccggcagtaggatgcccagagaccttgaaggtatctgacctgcagcccagctgtccagacccctgcaactgctgtatccccaaggcatccctctcctgttcacagcccaaggtggcctccgctggaccatggtcaaggatggacttccgtccacctgtgactgctgcgtgggcggccacccgaggcgtgtgggaactggatgcaaagccatgaagatcagaactggacagttccaccgaaacccacgcccagaggatgatcactgcccgcccaaggacatgcaggaaatccatgattggactcgatgaggggccagaactgatctctgtctcaggacattccagaaggaccaggatatgcccctccctttgctgatacaccagtgaccctacttctcatggagcatgcacaggtcaccctggagactgctccctttgttgtttcctgacccagggaccttggacagtcatcagtacctgctggctccagcctcagtgcctgggcttggcagtgtctcttggcatcgagaggcagccatgcctgtgggggctgcaggtcatcctggtaccttctaccagtagtgacttgggaagagccccaccccccaacccaggggctcaggccccaattttctaatcaggaatgacaataaagcttatgtcttccccc

SEQ ID NO: 2630 - DNA, 178 bp, Rattus norvegicus
  Genbank Accession No. U75404
tttttgattgtactcttctatgctggaccgaattcatatgcagatcgaagtcactcctgttctttacagatggtattttgatagatactggagtttgtctgtgttatatctgtccccttctttaagaacaatgttgcattacgttcctttggataaattgtgatttgacaactgattt

SEQ ID NO: 2631 - DNA, 187 bp, Rattus norvegicus
  Genbank Accession No. U75405
  misc_feature (1)..(187): n = a or c or g or t
aatctgttccctcccacccagcccacttncccccaaccctggaaacagaccaacaacccaaactcaatttccccaaaagcnnaaaattgggagacaattttacatggactttggaaaacatttttttcctttgcattcatctctcaaacttagtttttatctttgaccaactgaacgtgnccaaaaa

SEQ ID NO: 2632 - DNA, 219 bp, Rattus norvegicus
  Genbank Accession No. U75923
  misc_feature (1)..(219): n = a or c or g or t
gagagagtgtttactttgatttaatcaaacttaaaatatttcatcaaattacccaggaaaatccaggtagcagaaatatataacatatccatttcttacaaggtcacaaatcagttttacaaggctatatatatatgtatgtatatgtactatgccatttaaaccacttccgctttctgtactgaagaactcgagwnwgaaataagctttgtggtgcta

SEQ ID NO: 2633 - DNA, 1690 bp, Rattus norvegicus
  Genbank Accession No. U76206
aattctctcttccgcaccctgggttctgtggatgaaacttgcctctgagaatcctgaacatggagaaatagagataaataccccagaagagggggagtaagtgttcacaaccttggtgggtttcgcctcatgtctgtccctccactttaagagatgccggtcacctgagggccacaaactgcgctctaagtaaccagcctgcctttctacccagatctttgtctccagaagtgagaagatggacaacacaacaaccacagaacctccaaagcagccctgcacccggaacaccctgatcacacagcagatcatccccatgttgtactgtgtggtcttcatcacaggggtcctcctcaacggaatatcgggatggatattcttttacgtgcccagctctaagagttttatcatctatctcaagaacatagttgtggctgactttctcatgggcctcactttccctttcaaagtcctcagcgactcaggcctcggtccctggcagctgaatgtgtttgtattcagggtgtctgccgtgatcttctacgtcaacatgtacgtcagcatcgcgttcttcgggctcatcagctttgacaggtactataaaatcgtgaagccccttctggtgtctatcgtccagtcagtgaactacagcaaagtgctgtccgtgcttgtgtgggtgctcatgcttctcctcgctgtccccaacatcattctgacaaaccagagtgtcaaggatgtcactaacatacagtgcatggaactcaaaaacgagctggggcggaagtggcacaaggcgtctaactatgtcttcgtgagcattttctggatcgtgttccttctgctgaccgtcttctacatggccataacgaggaagatcttcaagtctcacctcaagtccagaaagaattccatctccgtcaaaaggaagtccagccgcaatatattcagcattgtgctcgcatttgtcgcctgtttcgcgccttaccacgttgccaggatcccctacaccaagagccagacggaaggacactacagctgccaggccaaggagaccctgctctatacgaaagaattcaccctgctgctctcggctgccaatgtgtgtctggaccccatatctatttcttcttatgccagccgtttagagaagtcttgaataagaagttaagaatgtcactaacagtccagaatgacctagagacttccaaaaccagaaggggaaatatgattcaggaaagcacagatactttgcaattctcaccctttccaagtattatggaccttgttacacggtaattaagatgtatgaagtgaaaagcagaaaagtataataaaaatgaaaggtaagttcccatgtaaagtgaaagtctacagcacgcagaaaagtataataaaaatgaaaggtaagttcccatgtaaagtgaaagtctacagcacgtcacatctttttagaaatcgaatggagaagtggcatgtgggtgctagtctgcgagttaccccaaaactaaactctctcttctattaacgggcttcttagaagacacccaccctttcagaagttcctcctgagtatccttctaagtaatgctcacctctgtttcatgctttgttctgtgtatgcgccaataaacaagttgtctttaaaaccccaaaaaaaaaaaaaaaaaaaagtactagtcgacgcgtggcc

SEQ ID NO: 2634 - DNA, 429 bp, Rattus norvegicus
  Genbank Accession No. U77829
gtgaggcgaagctgagcaggaatggccctgtggacctctgtgatgggacatctggtggaatctcacaggcagttctgtggcaaagatggatgaaagctaaggactcatgaggaagctggataactgaacaaagccatgtacaagaatgggaagccagaaaatgggatggtggagtttgaatcaggtggacagttctaaaagtacaaatgatttcgtataaaggtaccacatgtgggtccctttaactgaaggcatggcaagctccacacaaggtccttcatttctgaatttcaagggctcctctgacaagtggacagtgcagtgggtgcaccttttccagaggtgactggatggatgcttgaacagaagatttgccaaatagacattgtgctgtcaagaattttaccattaaaagtgcattattgtagc

SEQ ID NO: 2635 - DNA, 3903 bp, Rattus norvegicus
  Genbank Accession No. U83119
aggaagcaagaaactaatcgtcttggcaacaaaacaaagagaatgaaagcacacaaacataacctcacatccaaatatgaatataaagggagcaataatcactattccttaatatctctcaatatcaatggcctcaactccccaataaaaagacatagattaacaaactggatacgcaatgaggaccctgcattctgctgcctacaggaaacacacctcagagacaaagacagacattacctcagagtgaaaggctggaaaacaactttccaagcaaatggtcagaagaagcaagctggagtagccattctaatatcaaataaaatcaatttccaactaaaagtcatcaaaaaagataaggaaggacacttcatattcatcaaaggaaaaatccaccaagatgaactctcaatcctaaatatctatgccccaaatacaagggcacctacatacgtaaaagaaaccttactaaagctcaaaacacacattgcacctcacacaataatagtgggagacttcaacaccccactctcatcaatggacagatcatggaaacagaaattaaacagtgatgtcgacagactaagagaagtcatgagccaaatggacttaacggatatttatagaacattctatcctaaagcaaaaggatataccttcttctcagctcctcatggtactttctccaaaattgaccatataattggtcaaaaaacgggcctcaacaggtacagaaagatagagataatcccatgcatgctatcggaccaccacggcctaaaactggtcttcaataacaataagggaagaatgcccacatatacgtggaaattgaacaatgctctactcaatgataacctggtcaaggaagaaataaagaaagaaattaaaaagtttttagaatttaatgaaaatgaagatacaacatactcaaacttatgggacacaatgaaagctgtgctaagaggaaaactcatagcgctgagtgcctgcagaaagaaacaggaaagagcatatgtcagcagcttgacaacacacctaaaagctctagaacaaaaagaagcaaatacgcccaggaggagtagaaggcaggaaataatcaaactcagagctgaaatcaaccaagtagaaacaaaaaggaccatagaaagaatcaacagaaccaaaagttggttctttgagaaaatcaacaagatagataaacccttagccagactaacgagaggacacagagagtgcgtccaaattaacaaaatcagaaatgaaaagggagacataactacagattcagaggaaattcaaaaaatcatcagatcttactataaaaacctatattcaacaaaatttgaaaatcttcaggaaatggacaatttcctagacagataccaggtatcgaagttaaatcaggaacagataaaccagttaaacaaccccataactcctaaggaaatagaagcagtcactaaaggtctcccaaccaaaaagagcccaggtccagacgggtttagtgcagaattctatcaaaccttcatagaagacctcataccaatattatccaaactattccacaaaattgaaacagatggagcactaccgaattccttctatgaagccacaattactcttatacctaaaccacacaaagacacgacaaagaaagagaacttcagaccaatttcccttatgaatatcaacgcaaaaatactcaataaaattctggcaaaccgaattcaagagcacatcaaaacaatcatccaccatgatcaagtaggcttcatcccaggcatgcagggatggtttaatatacggaaaaccatcaacgtgatccattatataaacaaactgaaagaacagaaccacatgatcatttcattagatgctgagaaagcatttgacaaaattcaacaccccttcatgataaaagtcctggaaagaataggaattcaaggcccatacctaaacatagtaaaagccatatacagcaaaccagttgctaacattaaactaaatggagagaaacttgaagcaatcccactaaaatcagggactagacaaggctgcccactctctccctacttattcaatatagttcttgaagttctagccagaccaatcagaaaacaaaaggagatcaaggggatacagatcggaaaagaagaggtcaaaatatcactatttgcagatgacatgatagtatatttaagtgatcccaaaagttccaccagagaacaactaaagctgataaacaacttcagcaaagtggctgggtataaaattaactcaaataaatcagttgccttcctctatacaaaagagaaacaagccgagaaagaaattagggaaacgacacccttcataatagacccaaataatataaagtacctcggtgtgactttaaccaagcaagtaaaagatctgtacaataagaacttcaagacactgaggaaagaaattgaagaagacctcagaagatggaaagatctcccatgctcatggattggcaggattaatatagtaaaaatggccattttaccaaaagcaatctacagattcaatgcaatccccatcaaaataccaatccaattcttcaaagagttagacagaacaatttgcaaattcatctggaataacaaaaaacccaggatagctaaagctatcctcaacaataaaaggacttcagggggaatcactatccctgaactcaagcagtattacagagcaatagtgataaaaactgcatggtattggtacagagacagacagatagaccaatggaatagaattgaagacccagaaatgaactcacacacctatggtcacttgatttttgacaaaggagccaaaaccatccaatggaaaaaagatagcattttcagcaaatggtgctggttcaactggagggcaacatgtagaagaatgcagatcgatccatgcttatcaccctgtacaaagcttaagtccaagtggatcaaggacctccacatcaaaccagacacactcaaactaatagaagaaaaactagggaagcatctggaacacatgggcactggaaaaaatttcctgaacaaaacaccaatggcttatgctctaagatcaagaattgacaaatgggatctcataaaactgcaaagcttctgtaaggcaaaggacactgtggttaggacaaaacggcaaccaacagattgggaaaagatctttaccaaccctacaacagatagaggccttatatccaaaatatacaaagaactcaagaagttagaccgcagggaaacaaataaccctattaaaaaatggggttcagagctaaacaaagaattcacagctgaggaatgccgaatggctgagaaacacctaaagaaatgttcaacatctttagtcataagggaaatgcaaatcaaaacaaccctgagatttcacctcacaccagtgagaatggctaagatcaaaaactcaggggacaacagatgctggcgaggatgtggagaaagaggaacactcctccattgttggtgggattgcaaactggtacaaccattctggaaatcagtctggaggatcctcagaaaattggacattgaactgcctgaggatccagctatacctctcttgggcatatacccaaaagatgccccaacatataaaaaagacacgtgctccactatgttcattgcagccttatttataatagccagaagctggaaagaacccagatgcccttcaacagaggaatggatacagaaaatgtggtacatctacacaatggaatattactcagctatcaaaaacaacgactttatgaaattcgtaggcaaatggctggaactggaaaatatcatcctgagtgagctaacccaaacacagaaagacatacatggtatgtactcactgatatgtggctattag

SEQ ID NO: 2636 - DNA, 1114 bp, Rattus norvegicus
  Genbank Accession No. U89745
  misc_feature (1)..(1114): n = a or c or g or t
tcagtnatcggccgaattcgcggccgctccggcctccactgttttgtcagtcagttagggggtgggcccaaccttagagatgggggcccggccttcactgttctgttattcagagggtggggcctgacctccacttttctgttattcagggggcagggcctgacctccacttttctgttattcagggggcagggtctgacctccactgttctgtcagtcatttggggggcggggcctggtggagctataatgcctgttcctgaggtggccctgcccagtccagcactggactaaccacaggccaagtgctgagtaactaagacccaggcctgctgggtgaggggttccgagaactcatgaacctctgtcctgcctctgagggactttgaagattgttgccctgcagtgtccctagcagttaaacccagccgccatgttcaagaggtttccccttagctgctgtgcctctctgggctgggcgggtggtttaaagcatgcatcaccaaggagccagtgtgtcctttgcttggctggacccagcctctgcttctgctccgtcctgggaatgcatctccttatatcactttcctctttcagaaccagaaggacctgggcctgcctgaaagctgggccgtccttgtttgtgctcctgccggggcccagtctctggaaggtggccttgagttaggcatccttggttgaatcctgtcccactgaacaggtgttaactttgaaccacactcactctgagccttggcttccctttctgtaaaatgggggtractgagccaaggstgcttgtgggaggracacacaggcstgaggstggccctgtgagcstgtgcctttccttccctccctgtgaggtcttggggaggagccytgctggtgcacatgtccttatccctctcbcggataatacacacatttgtaggkncgggcgcattyttacacacacacacacacacacacacacacacacacacacacaccccamtnatcagtgtctkgtgttcatwtcccagntacacacattccctgtgcccacccacactcacacaggatnccttgctctttaaactacaaccccacacagtcccctgcacaccccaaa

SEQ ID NO: 2637 - DNA, 4413 bp, Rattus norvegicus
  Genbank Accession No. U90725
  misc_feature (1)..(4413): n = a or c or g or t
ggcgtcttgttcctgtttcgccacagttcctaccttatgagcttggattcctcacgctaataaaagaggagcagtaaaagctggcaggctgacagaggcaacctcaggacggactttctggctactgaccattttgctgtgtcttactaggattgtgtgtggacgtgagatcaaccatgagctccgttgcagttttgacccaagagagttttgctgaacatcgaagtgggctggttccacaacaaatcatagttgccacattaaattcagaagaagaaagtgaccctccaacctacaaggatgccttccctccactgcctgagaaagcagcttgcttggaaagtgcccaagaacctgctggagcctggagtaacaagatccggcccatcaaggcctctgtcatcactcaggtgtttcatgtacccctggaggagagaaaatataaggacatgaaccagtttggagaaggtgaacaagcaaaaatctgccttgagatcatgcaaaggactggtgctcacctggagctctctctggctaaagaccaaggtctctccatcatggtctcagggaagctggatgcagtcatgaaagcccggaaagacattgttgctagactacagacacaggcctcagccactgttcccattcctaaagagcaccaccgctttgttattggcaaaaacggagaaaaactacaagacttagaactgaaaactgctaccaaaatccagatcccacgcccagatgaccccagtaatcagatcaagatcactggcaccaaagaaggnatcgagaaagctcgccatgaggtccttctgatctctgctgagcaggacaagcgtgccgtaaagaggctagaagtggagaaggccttccaccccttcatcgctgggccgtacaatagacttgtgggtgaaatcatgcaggaaacagggacgcgaatcaacatccctccacccagtgttaaccgtacagaaatcgtcttcactggagaaaaggaacagctggctcaggctgtggctcgtattaagaagatttatgaggaaaagaagaagaagactacgaccattgcggtagaggtgaagaaatctcaacacaagtatgtcatcgggccgaagggcaactcactgcaagagatcctggaacgtactggagtctccgttgagatcccgccctcagacagcatctccgagactgtgatacttagaggcgagcctgaaaagctgggacaggcattgactgaagtctatgccaaggccaacagttttacagtgtcctcagtctctgccccttcctggcttcaccgtttcatcattggtaagaaagggcagaacctggccaaaatcactcaccaaatgccaaaggttcacattgagttcacagaaggtgaggacaagatcaccctggagggccccacagaagatgtgaatgttgcccaggaacagattgaaggaatggtcaaagacctgattaatcggatggactatgtagaaatcaacattgaccataaattccacagacacctcattgggaagagtggagccaacatcaacagaatcaaagaccagtacaaagtgtctgtgcgcatcccccctgacagcgagaagagtaacctgatccgaattgagggagacccacaaggtgtgcaacaggccaagcgggagctgctggagcttgcttctcgcatggaaaatgagcgcaccaaggatctaatcattgagcaaagatttcatcgcacaatcattgggcagaaaggtgaacggattcgagaaattcgtgacaaattcccagaggtgatcatcaactttccggatccagcacaaaagagtgagattgttcaactcagaggccccaagaatgaggtggagaaatgtaccaagtacatgcagaaaatggttgcagatctggtggaaaatagctattcaatttctgtaccgatcttcaaacagtttcacaagaatatcattgggaaaggaggtgcaaacattaaaaagattcgtgaagagagcaacaccaagattgaccttcctgccgagaacagcaactcggagaccattgtcatcactggcaagcgagccaactgtgaagccgcccggagccggatcctgtccatccagaaagatctggccaacatagctgaggtggaggtctcaatccctgccaaactacacaactctctcattggcaccaagggtcgtctgatccgctccatcatggaggaatgtggtggcgtccatattcactttcctgtggaaggttctggtagtgacactgttgtcatcaggggtccttcctcagatgtggagaaggccaagaagcagcttctgcacctggctgaggagaagcaaaccaagagttttactgtggatatccgggccaagccagaataccacaaattcctcattggcaaagggggaggtaaaatccgcaaggtgcgcgacagtactggagcccgcattatatttccggctgctgaggataaggaccaggacctgataacaatcataggaaaggaagatgctgtccgtgaggcacaaaaggagctggaagcattgatccagaacctggataatgtggttgaagactacatgctggtggaccccagacaccaccgccattttgttatccgaagaggacaggtattacgagagattgctgaagaatatggcggggtgatggtcagcttcccacgctctggcacacagagtgacaaagtcactctcaagggtgccaaagactgtgtggaggcagccaagaagcgaattcaggaaatcattgaggatctggaagctcaagtaacgctggaatgtgctataccccagaagtttcatcgttcggtcatgggtcccaaaggttcaagaatccagcagatcactcgggactacaatgttcaaattaagttcccagacagagaggaaaacccagttcacagtgtagagccttccatccaggagaatggagatgaggctggagagggcagagaggccaaggagaccgacccgggatctcccaggaggtgtgacatcatagttatctctggccggaaagagaaatgtgaggctgccaaggaagccctggaggcactggttccagtcaccatcgaggtagaggtaccctttgatcttcaccgctacatcattgggcagaaaggaagtggaatccgcaagatgatggatgagtttgaggtgaatatacatgtgccagcccccgaactgcagtcacacaccattgccatcactggccttgcagcaaatttggacagggctaaggcggggctactggatcgagtaaaggagctgcaggctgagcaggaagatcgggctttaaggagttttaagctgagtgtcactgtagaccccaaataccatcccaaaattatcgggggaaaaggggcagtgatcacacagatccgattggaacatgatgtgaacatccaatttcctgataaggacgatgggaatcagccccaggaccaaatcaccatcacagggtatgagaagaacactgaagctgcccgtgatgctatcctgaaaattgtgggtgagcttgagcagatggtttctgaggatgttcccttggatcaccgtgtgcatgcccgaatcattggtgccagaggcaaagccatccggaaaatcatggatgagttcaaggtggacattcgcttcccacagagcggagctccagaccctaactgcgtcactgtgacaggactcccggagaatgtggaggaagctatcgaccatatcctcaacctagaagaggaatatctggctgatgtggtggacagtgaggcgctgcaagtttacatgaagcccccagcacatgaagagtccaaggcaccatccaaaggctttgtggtgcgagatgctccctggacctccaacagcagtgagaaggctcctgatatgagcagctctgaagaaattcccacctttggggctcaagtggcccccaagaccctcccgtggggccccaaacgataatgatcaaaaagaaactttccagcctgctgcccaaacccaaccacacaatggtttgtctcaatctgactcagcagctggaccctcgtaaattgttgatgctccccctccccgaagtctcgcagcaaagcctggtgggctggccttctgtggctgcttcccctggcctggtcagcacccgcaggctcagggtctgctcctgacgctgtgctctgggaaagtgcacgccactgcgtgaaacactaagcaaggtaatcgagcatttcgtgatcacagactccagcttcctggtccacccagcatgtagtcagcattctgactttcacagcagagttccacagcggctaggagttgacttccttgtgtcatgacctcaggaaataaatttccttgactttataaaagccaaaaaaaaaaaaaaaaaaaaaaaaaa

SEQ ID NO: 2638 - DNA, 1636 bp, Rattus norvegicus
  Genbank Accession No. U95157
aatcaaagtggcggaatttcttgccaacatgccagaccctactcaggatgaggtgcgaggagatgaagaggagggagagaggaagccattagagtcagccctgccctctgaagacctaacggacttgaaggaactgacggaggaaagtgaccttctttcagacatatttggcttggatctgaagagagaaggagggcagtacaaactaattcctcacaacccaaatgctggtctcagtgacctcatgacgaaccccatccctgtccctgaggtacaagaaaagtttcaggagcagaaggtaaaagaagaaaaggaaggaaaggaagaaaccaagtctgaaccggagaaggctgagggagaggatggagaaaaagaagaaaaagccaaagatgataagggtaaacagaagttgaggcagcttcatacacatcgatatggggagcctgaggtccccgagtcagcattctggaagaaaatcatagcctaccaacagaagctgctgaactattttgctcgcaacttttacaacatgagaatgctggccctgtttgtcgccttcgccatcaatttcatcctgctcttctacaaggtctccacttcttctgtggttgaaggaaaggagctgcctacccgaacttccagcgatgccgctaaagtgaccaccagcctggacagcagcccccacagaatcattgcggttcactacgtcctggaggagagtagcggctacatggaacccaccttgcgcatcctagccatcctccacaccatcatatccttcttctgcatcatcggatactactgcctgaaagtccccttggttatttttaagcgagagaaggaagtggcacggaagttggagtttgatgggctttacattacggagcagccatcggaagacgatatcaaaggccagtgggacagactggtgatcaacacacagtcatttcccaataactactgggataaatttgttaaaagaaaggtaatggataaatatggagagttttatgggagagacagaatcagcgagttactgggcatggataaggctgcactggatttcagcgatgcaagagagaagaagaagcccaagaaagacagttccttgtctgctgtattgaactctattgacgtgaagtaccagatgtggaaacttggagtcgtgttcacagacaattccttcctctacctagcctggtatatgaccatgtctgttcttggacactacaacaactttttttttgctgcccacctccttgacatcgcgatgggcttcaagaccttgagaactatcctgtcctcagttacccataatggcaaacagctcgtgttaactgttggcttgttggctgttgttgtatacctgtacactgttgtggcgttcaatctcttccgaaaattctacaataaaagcgaggatggtgacacgccggacatgaagtgtgacgacatgctgacgtgttacatgttccacatgtatgtgggcgtccgtgctggagggggcatcggtgatgaaattgaagacccagcaggagatgagtacgagatctaccgaatcatctttgatatcacattcttcttctttgtgattgtcatccttttggctatcatacaaggtttgatcattgatgct

SEQ ID NO: 2639 - DNA, 735 bp, Rattus norvegicus
  Genbank Accession No. X02904
acgcagctttgagtccacacctctgtctacgcagcagctatgccgccgtacaccattgtgtacttcccagttcgagggcgctgtgaggccacgcgcatgctgctggctgaccagggccagagctggaaggaggaggtggttaccatagatgtctggcttcaaggctcgctcaagtccacttgtctgtatgggcagctccccaagtttgaagatggagacctcaccctttaccaatctaatgccatcttgaggcacctgggtcgctctttagggctttatgggaaagaccagaaggaggctgccttggtggatatggtgaatgatggggtggaggaccttcgatgcaaatatggtaccctcatctacactaactatgagaatggtaaggatgactatgtgaaggccctgcctgggcatctgaaaccttttgagaccctgctgtcccagaaccagggaggcaaagctttcattgtgggtaaccagatttcctttgcagattacaacttgctggacctgctgctggtccaccaagtcctggcccctggctgcctggacaacttccccctgctctctgcctatgtggctcgcctcagtgcccgccccaagatcaaggcctttctgtcctcccctgaccatttgaaccgtcccatcaacggcaatggtaaacagtagtggacgaagggacaggaactccttgtcccccttttcccagactaataaagtttgtaaggcaga

SEQ ID NO: 2640 - DNA, 3811 bp, Rattus norvegicus
  Genbank Accession No. X03347
cgggctgtattgaaagaccccttcataaggcttagccagctaactgcagtaacgccattttgcaaggcatgggaaaataccagagctgatgttctcagaaaaacaagaacaaggaggtaaagagaggctggaaagtaccgggactagggccaagaacaaatggttcccagaaatagaggctggaaagtaccgggactagggccaaacaggatatctgtggtcaagcactagggccccggcccagggccaagaacagatggttcccagaaatagctaaaacaacaacagtttcaagagacccagaaactgtctcaaggttccccagatgaccggggatcaaccccaagcctcatttaaactaaccaatcagctcgcttctcgcttctgtacccgcgcttattgctgcccagctctataaaaagggtaagaaccccacactcggcgcgccagtcctccgatagactgagtcgcccgggtacccgtgtatccaataaagccttttgctgttgcatccgaatcgtggtctcgctgatccttgggagggtctcctcagagtgattgactgcccagcctgggggtctttcatttgggggctcgtccgggatccggagacccccgcccagggaccaccgacccaccgtcgggaggtaagctggccagcggtcgttttgtctccgtctctgtctttgtgcgtgtgtgtgtgtgccggcatctaatctttgcgcctgcgtctgtatctgtactagttagctaactagatctgtatctggcggttccgtgaaagaactgacgagttcgtattcccggccgcagccctgggagacgtctcagaggcatcgggggccatttttgtggcccaatctgtatctgagaacccgacccgtttcggactctttggagcttctccattgactgaaggatacgtggttctattgggcggcgaggggccgaaacgctcctctcctccatctgaatttttgctttcggttttccgccgaaaccgcgccgcgcgtcttatctgtctcagtgttattttgtcatttgtctgttcgttattgttttggaccgtttctaaaaatatgggacagaccgtaaccactcctttgagtctgaccctagaacactggggagacgtccagcgcattgcgtccaaccagtccgtggacgtcaagaagagacgctgggtcaccttctgttctgccgagtggccaactttcgatgtggggtggccgcaagatggtacttttaatttggacattattttacaggttaaatctaaggtgttctctcccggtccccacggacacccggatcaggtcccatacattgtcacctgggaggctattgcctatgaaccccctccgtgggtcaaaccttttgtctctcccaaactctccccctctccaaccgctcccatcctcccatccggtccttcgacccaacctccgccccgatctgccctttaccctgcccttaccccctctataaaacccagaccttctaaacctcaggttctctccgatgacggcggacctctcattgaccttctcacagaagaccctccgccgtacggagaacagggaccgtcctcctctgacggggatggcgacagagaagaggccacctccacttctgagattcctgccccctctcccatggtgtctcgcctgcggggcaaaagagacccccccgcggcagattccactacctctcgggctttcccactccgtttggggggtaatggtcagaaaaataataacccttccttttctgaagatccaggtaaattgactgccttaatcgagtctgtcctcaccacccaccagcctacctgggacgactgtcagcagttgctggggactctgctgacaggagaagaaaagcagcgggtgctcctggaggccagaaaggcagtccggggcaacgatgggcgccccacccagatgcctaatgaagtcaatgccgccttccccctcgaacgtcccgattgggattatacaactcctgaagacagcctttcctactaccattccccagccgactccttctccagcatgggctctcctgtcaacacacaggacttttgcgcagatctgtccgtctctagtgccaactttatccccacggagacagccatctccaccagccctgacctgcagtggctggtgcagcccactctggtctcctccgtggccccatcgcagaccagagcgccccatccttacggactccccacccagtctgctggggcttacgccagagcgggaatggtgaagaccgtgtcaggaggcagagcgcagagcatcggcagaaggggcaaagtagagcagctatctcctgaagaggaagtgaaacggagaatccgaagagaacggaataagatggctgcagccaagtgccggaatcggaggagggagctgacagatacactccaagcggagacagatcaacttgaagatgagaagtctgcgttgcagactgagattgccaatctgctgaaagagaaggaaaaactggagtttattttggcagcccaccgacctgcctgcaagatccccgatgaccttggcttcccagaggagatgtctgtggcctccctagatttgactggaggtctgctgccccttctcaacgaccctgagcccaagccatccttggagccagtcaagagcagctttgatgacttcttgtttccggcatcatctggacacagtggctttattagcatggcagggtggcaataggacttagaaattggcattggggcccttcttcttccctaaggtgggcacaacattgacaaagcgccggttgtactgcattcgcctcttggcccggcctgtcttcttcttcttcttttcctgtttggccaccttgggagtctgacctctcacttttccagcccgagccaggaaaccgtgaactttacctcccagcatgcggcctgctacttccagagtggtcagggcctctacgccacactggcctagggtggcctcatcctcctgcggcgagcctgccagaagcacgacttgatcgtcgggggcaatgccttccagggaggtcacatgatctttgatctgggcgaccgtcccctggccggtcacctcgagggtgtgtagttcctgggcgcggacaaagagctgcatgttggctacttaagacagtaaaagattaaaaatcacgtgaataaaagattttattcagtttacagaaagaggggggaatgaaagaccccttcataaggcttagccagctaactgcagtaacgccattttgcaaggcatgggaaaataccagagctgatgttctcagaaaaacaagaacaaggaggtaaagagaggctggaaagtaccgggactagggccaagaacaaatggttcccagaaatagaggctggaaagtaccgggactagggccaaacaggatatctgtggtcaagcactagggccccggccagggccaagaacagatggttcccagaaatagctaaaacaacaacagtttcaagagacccagaaactgtctcaaggttccccagatgaccggggatcaaccccaagcctcatttaaactaaccaatcagctcgcttctcgcttctgtacccgcgcttattgctgcccagctctataaaaagggtaagaaccccacactcggcgcgccagtcctccgatagactgagtcgcccgggtacccgtgtatccaataaagccttttgctgttgcatccgaatcgtggtctcgctgatccttgggagggtctcctcagagtgattgactgcccagcctgggggtctttcagtatgtaata

SEQ ID NO: 2641 - DNA, 2116 bp, Rattus norvegicus
  Genbank Accession No. X06769
cgcaactgagaagactggatagagccggcggagccgcgaacgagcagtgaccgcgctcccacccagctctgctctgcagctcccaccagtgtctacccctggacccctcgccgagctttgcccaaaccacgaccatgatgttctcgggtttcaacgcggactacgaggcgtcatcctcccgctgcagtagcgcctccccggccggggacagcctttcctactaccattccccagccgactccttctccagcatgggctcccctgtcaacacacaggacttttgcgcagatctgtccgtctctagtgccaactttatccccacggtgacagccatctccaccagcccagacctgcagtggctggtgcagcccactctggtctcctccgtggccccatcgcagaccagagcgccccatccttacggactccccaccccgtcgaccggggcttacgccagagcgggagtggtgaagaccatgtcaggcggcagagcgcagagcatcggcagaaggggcaaagtagagcagctatctcctgaagaggaagagaaacggagaatccgaagggaaaggaataagatggctgcagccaagtgccggaatcggaggagggagctgacagatacgctccaagcggagacagatcaacttgaagacgagaagtctgcgttgcagaccgagattgccaatctactgaaagagaaggaaaaactggagtttattttggcagcccaccgacctgcctgcaagatccccaatgacctgggcttcccagaggagatgtctgtgacctccctggacttgactgggggtctgcctgaggctaccaccccagagtctgaggaggccttcaccctgcctcttctcaatgaccctgagcccaagccatccttggagccggtcaagaacattagcaacatggagctgaaggctgaaccctttgatgacttcttgtttccggcatcatctaggcccagtggctcggagactgcccgctctgtgccagatgtggacctgtctggttccttctatgcagcagactgggagcctctgcacagcagttccctggggatggggcccatggtcacagagctggagcccctgtgcactcccgttgtcacctgcactcccagctgcactacctatacgtcttcctttgtcttcacctaccccgaggctgactccttccctagctgcgcagctgcccaccgaaagggcagcagcagcaacgagccctcctctgactcactgagctcgcccacactgctagccctgtgagcagtcagagaaggcagggcagccggcactgactgagctggtgcattacagagaggagaaacacgtcttccctcgaggggttcccgtagacctagggaggaccttatctgtgcgtgaaacacaccaagctgtggacctcaaggacttgaaagcatccacatctggactccagtcctcacctcttccggagatgtagcaaaaaaacaaaaaaacaaaacaaaaaaaaaacaaaacaaaaaatcaaaagcaaccgcatggagtgtattgtttgtagtgacacctgagagctggtagttagtagcatgtgagccaggcctgggtctgtgtctcttttctctttctccttagtcttctcatagcattaactaatctgttgggttcattattggaattaacctggtgctggatatttttcggattgtatctagtgcagctgattttaacaatacctactgtgttcctggcaatagtgtgttccaatttagaaatgaccaatattaaactaagaaaagatagaactttattttccggtagatagaaataaatcgctatatccacgtactgtagctcttcagcgtccatgttcattgtcatgtaactgatcatgcattgttgaggtggtctgaatgttctgacattaacagttttccatgaaaacgttttattgtgttttcaatttatttattaagatggattctcagatatttatatttttattttatttttttctatcctgaggtctttcgacatgtggaaagtgaatttgaatgaaaaaattttaagcattgtttgcttattgttccaagacattgtcaataaaagcatttaagttgaatgcg

SEQ ID NO: 2642 - DNA, 2481 bp, Rattus norvegicus
  Genbank Accession No. X07551
gatctattagacacaaaacctaaccagagaaggaaatatgcggacctgaacctttgcagacaaagcttcctccctctgctcagttgtaagctacttggtctgagccgtctgtgtaccaaagagtggacaaggcagtcaggatagcagaaatcaaacacatggcatcccaccattgtgcggcgcgtgtcacagagggaaagacaggagtgtaacccacactgagagtggtagggagacgcgggtggtggaaatgcatcaaaaacaatgatgttcacggtactcgtcagagcattttctacccgtttgttttaaaacattcttttcctcttcctgttttccactttcccaccatccacctaaattcctcagccgaccacgtaggctcctatggtataactgtgtatcagtatcatgaatccaaaggccagtacacacatgaatttgatggtgacgagagattctatgtggacttggataagaaggagaccatctggaggatccccgagtttggacaactgataagctttgacccccaaggtgcacttcgaaatatagctataataaaacacaatttggaaatcttgatgaagaggtcaaattcaaccccagctgtcaacggtacgtgctcaccaccctgctcccccctcccttccctggggggttaggggatgtgatcaggacattaatggtccaataaaatcctctcctttccaaggagaccccggatctcttcatcactggagactcatcccctctcttcttgtttttaaagatttatttatttattatatctaagtacacggtagctgtcttcggacacaccagagagagggcatcagatcccattacagatggttgtgagccaccatgtggttgctgggaattgaactcaggacctctggaagagcagtcagtgctcttaaccactgagccatctctccggcccatcccttctcttcttaaaaatcacacatttcatgtaatatacagctcactattccacaatgctctcctcgaatcttttggaaaagccccgacagacatcctacctgaactccctagacgagaggggcacagggatcaagtggagggcacattagctccaagcagaggaatcgggctctttgactttcatatgtgtaagacttgtcaagaaggctctctcactagacagtgcagggcttcagggagagaagctcccatcagcctctgacatccagaccatttcctttgcagaggttcctgaggcgaccgtgttttccaagtcccctgtgctgctgggtcagcccaacaccctcatctgctttgtagacaacatctttcctcctgtgatcaatatcacatggttgagaaacagcaagccactcacagaaggcgtttatgagaccagcttccttatcaacagtgactattccttccacaagatggcttacctcaccttcatcccttccaacgacgacatttatgactgcaaggtggagcactggagcctggacgagccggttctaagacactggggtgtgtatgagctctgccacttctggcactttctcgttcactgtcacttctggaacagcatggcttctggcttcaagtgaccaaaactcactttccactcttaaagtttctaaggctagagttcgtgtcatcccattagcccagcctcagagaccagtaggttaactcctcctcacctggtcctgtcttacacatacatgagtcccttctgactcaaagcttctctctctcagaacctgagattccagcccccatgtcagagctgacagagactgtggtctgtgccctggggttgtctgtgggtctcgtgggcatcgtggtgggcaccatcttcatcattcaaggcctgcgatcagtggctccctccagacacccagggcccttgtgagtcacaccctgggaaagaaggtaagggtttgtgtttgtgggaaacaaaggcacgcatggggaggggaaggaaggggagacatgaaagtttgttgttggaactttgctggagcctctgaacccatctttcctgtgtgttttgttgtaggtgcgtggccctctacagggaagatgtagtgtgtgggggtgacctggcacagtgtgttttctggcccaattcatcgtgttctctctcttctcctggtgtctcccatcttgctcttcccttggcccccaggctgtccacctcatggctctcacgcccttggaattctcccctgacctgagtttcatttttggcatcttccaagtcgaatctactatagattccgagaccctgattaatgctccaccaaaccaataaacctcttataagttgtcttctttgtttttctgtctcccattttggagcttactggagccaggcccatgtaatcctgtgtccagtgtcacaggaataaccaatgcagcccagaatggtttggtatcttagccaaggttgactttcaaatttttttgttcagctgacatctcacg

SEQ ID NO: 2643 - DNA, 1857 bp, Rattus norvegicus
  Genbank Accession No. X07686
aagcttaaaactttaaaatcgtatgttcttaagttaccaaatattttctattacttcatctctcttgtcttgatcacgcagcaaacttgttttggcacaaattaccacatgaattctagagcccagtttcatatgctattcacagaatgatgtcatggtaatgatgccagccacagacagtgggcttccaacctcaataaattgtacttttcttatgttgtctttttttgtaggaaagacattaaacccttataatccaaaagatcagaagcagggagctcatagccaatctaagtgctacctgcaattctatcaattagaaatgggaccaatctaaggtcactccagggcatctccagggaaagggtacatgtttaatgtcaccaagctaccagcgagtagttcctgggtgcagattcctttagtcatgcacagtagattaattccaagaatgacagtcaagctcctgggcagcaccccgtgagcaaacttgagccttgggaccacaggtaagaccaacttttctgctgcaagagacctgcctggtgatctcgggacatacagaggcagaattcctctaggaccgggcacctcctgtgtttaccgggagtcccacacccgcggatcccggcccgcagcagctctttgctcccagacaccgtgggagagagaccccaccacctggtcaggtgggcactcctgaggctgcagagcggaatagaccaccaacactgcccacccctccctacatccctggcccaagaggaaactgtataaggcctctgggttcccgtgggggagggcccaggagtggcagtacctcttcctctgagacaccgccggaacctgaaggaaacagaccggataaacagttctctgcacccaaatcccgtgggagggagagctaaaccctcagagaggcagacatgcctgggaacccagaagagactgcagtctgcacacacatctcggatgccagaggaaaacaccaaacgccatctggaaccctggtgcactgaagttcctggaaacagcggcgcagatcttcctggttgctgcagccgcagagagctcgagggcagcaccccgagagcgaacttgagcctcgggaccacagggaagaccaacttttctgctgcaagtgacctgtctggtgaactcaagacagaggcccacaggaacagctgaagacctgtagagaggaaaaactacacgcccgaaagcagaacactctgtcgccataacaggctgaaagaaaacaggaaaacaggtctacagcactcctgacacacaggcttatagggcagtctagccactgtcagaaatagcagaacaaagtaacactagagataatctgatggcaagaggcaagcgcaggaacccaagcaacagaaaccaagactacatggcaccatcggagcccaattctcccaccaaaacaaacatggaatatccaaacacaccagaaaagcaagatctagtttcaaaatcatatttgatcatgatgctggaggacttcaagaaagacgtgaagaactcccttagagaacaagtagaagactacagagaggaatcacaaaaatgcctgaaagaattccaggaaaacataattaaacaagtagaagcccatagagaggagtcacaaaaatccctgaaagaattccaggaaatcataaataaacaagtagaagcccatagagaggagtcacaaaaatccctgaaagaattccaggaaaacacaatcaaacagttgaaggaattaaaaatggaaatagaagcaatcaagaaagaacacatggaaacaaccctggatatagaaaaccaaaagaagagacaaggagctgtagatacaagctt

SEQ ID NO: 2644 - DNA, 1509 bp, Rattus norvegicus
  Genbank Accession No. X13411
gaagctgtccgggagtttgccaaggagattgatgtgtcttttgtgaaaattgaagaggtcatcggagcaggggagtttggagaagtgtacaagggccgattgaagctgccaggcaagagggaaatctatgtggccatcaagaccctgaaagctgggtactcagagaaacagcgtcgggattttctgagcgaggcgagcatcatgggccagtttgaccatcccaacatcattcgcctagagggtgttgtcaccaagagccgacctgtcatgatcattacggagttcatggagaatggcgctttagactctttcctccggcaaaatgacggacagttcaccgtgatccagcttgtggggatgctgaggggcatcgctgctggcatgaagtacctatctgagatgaattatgtgcaccgggacctggctgctaggaacattctggtgaacagcaacctggtgtgcaaagtgtctgactttggcctctctcgctacctccaggatgacacctcagaccccacctacaccagctccttgggggggaagatacctgttagatggacagctccagaggccatcgcctaccgcaagtttacgtcagccagcgatgtctggagctacgggattgtcatgtgggaagtaatgtcatttggagagagaccttactgggatatgtccaatcaagatgtcatcaatgccattgagcaggactaccggctgccccctcctatggactgcccagctgccctgcaccagctcatgctggactgttggcagaaggatcgaaatagccggccccgttttgcagagatcgtcaacaccctggacaagatgatccggaacccagctagtctcaagactgtggcaaccatcaccgctgtgccttcccaacccctgcttgaccgctctatcccagacttcacggcctttaccaccgtggatgactggctaagtgccatcaaaatggtccagtacagggacagcttcctcaccgctggcttcacctccctccagctggtcacccagatgacatcagaagacctcctgagaataggggtcaccttggcaggccatcagaagaagattcttagcagcatccactcgatgagggtccagatgaaccagtcaccgtcggtaatggcatgagaactcgatgttcctaggggaggagaggaatgaaaaggaccagggtcaaaggggaaacagaggttgaccacggtggaatgtgccagaaagatcagcttcttggctgagaaacaacttcccacctgtgaagaatgaactggacctgctgcccatgggcaaccgccatttctcggccatggaagtgtgtagaagccgtgggaaaccaaacgcgtaatgattgacgataaagacagagaaaggtgatgctaaacagaagcgaagctgaaaccgtatgcgttgggaaccagggtgaactcagttcccatctgagagggactggagttccccgtctgcaggaagaaaggaaggaggtggagggaagagagg

SEQ ID NO: 2645 - DNA, 591 bp, Rattus norvegicus
  Genbank Accession No. X14181
cttttgtgagtggcagtgaacgagcacgcactgctatgaaggcgtcgggcacgcttcgggagtacaaggtggtggggcgttgcttgccaaccccaaaatgccacacaccgccactgtaccgaatgcgaatctttgcacccaaccatgtggtggccaagtcccgcttctggtactttgtgtcgcagctgaagaagatgaagaagtcatccggggaaattgtgtactgtgggcaggtgtttgagaagtcacccctgcgtgtgaagaacttcggcatctggctgcgctatgattcccgaagtggcactcacaacatgtaccgagagtaccgggacctgaccactgccggcgcggtcacacagtgctaccgagacatgggtgcccgacaccgtgcccgtgcgcactccatccagatcatgaaggtggaagagattgcagctggcaagtgccgccggccagctgtcaagcagttccacgactccaagatcaagttcccattgccccaccgtgtgttgcggcgccagcacaaaccacgcttcaccaccaagaggccaaacaccttcttctagacaccagagacccactgaataaaag

SEQ ID NO: 2646 - DNA, 508 bp, Rattus norvegicus
  Genbank Accession No. X14671
tccttttgcggccatcgctggattgcagccgccaaaatgaagttcaatcccttcgtgacttctgaccgaagcaagaaccgcaaacggcatttcaatgcaccatctcacattcggaggaagatcatgtcttctccgctttccaaagaactgagacagaagtataatgttcggtctatgcccattcgaaaggacgacgaagttcaggttgttcgaggacactacaaaggccagcagattggcaaagtggtccaagtgtacaggaagaaatacgtcatctacattgagcgagtccagcgagagaaggctaacggcacaactgtccatgtgggcatccgccccagcaaggtggttatcaccaggctaaagctggacaaggaccgcaagaagatcctggagaggaaagccaagtcccggcaagtaggaaaggagaagggcaaatacaaggaagaaactatcgagaagatgcaggagtagaaaaataatgcccagttttcattaaataaagctt

SEQ ID NO: 2647 - DNA, 851 bp, Rattus norvegicus
  Genbank Accession No. X15013
cgagcggatgcccaaaggaaagaaggccaaggggaagaaggtggccccggcccccgccgtggtcaagaaacaagaggccaaaaaggtggtcaatcctttgtttgagaaaaggcctaagaacttcggcattgggcaggacatccagcccaaaagagatctcacgcgcttcgtcaaatggccccgctacatcaggctgcagcggcaaagagccatcctctataagcggctcaaagtacctcctgccatcaaccagttcacccaggccctggacaggcaaacagcgactcagctgcttaagcttgcccacaagtacaggccagagacaaagcaggagaagaagcagaggctgctggcccgcgctgagaagaaagctgctggcaaaggggacgtcccaactaagagaccacctgtcctccgagcaggggtcaatacagtcaccactttggtggagaacaagaaggctcagctggtggtgattgcccatgatgtagaccccattgagctggtggttttcctgcctgccctgtgtcgaaagatgggggtgccctactgcatcatcaagggaaaggccaggctggggcgcctggtccacaggaagacatgcaccactgttgccttcacacaggtgaactcggaagacaagggtgctctggctaagctggtggaagctattaggaccaattataatgacagatatgacgagatccgccgccactggggaggcaacgtcctgggtcctaagtctgtggctcgcattgccaagctggaaaaggcaaaggctaaagaactcgccactaagctgggttaaatgtacacttaagttttctgtacataaatataattacaaagtt

SEQ ID NO: 2648 - DNA, 544 bp, Rattus norvegicus
  Genbank Accession No. X17665
ctttccggtggcggcgcggcgcggtgaggagctcgtgttcatacttgtagctatgccgtccaagggtccgctgcagtccgttcaagtcttcggacgcaagaaaacagccacagctgtggcccactgcaaacgaggaaatgggctcatcaaggtgaatggacgtcccctggagatgatcgagccgcgcacgctgcagtacaagttactggagcctgttctgcttctgggcaaggagagatttgctggtgtggatatccgggtccgtgtgaagggtggtggtcatgtggcccaaatttatgctatccggcagtctatctcaaaagctctggtggcttattaccaaaaatatgtggatgaagcctctaagaaggagatcaaagatatcctcatccagtacgatcggaccctgcttgtagctgacccccgtcgctgcgaatccaagaagtttggcggtcccggtgcccgtgcccggtaccagaaatcctaccgataagccagtctcaaggatcagggtttacctttgtaataaacatcctgggacttt

SEQ ID NO: 2649 - DNA, 817 bp, Rattus norvegicus
  Genbank Accession No. X51536
agcggcgccgggcagaagatggcggtgcagatttccaagaagaggaagtttgtagctgatggcatcttcaaagctgaactgaatgagtttctcactcgggagctggctgaagatggctactctggagttgaagtccgagttacgccgaccagaacagaaatcattattttagccaccagaacacagaatgttcttggggagaagggtcgtcggatcagagagctgactgcagttgtccagaagcggtttggcttccctgaaggcagcgtagagctgtatgcagaaaaagtggccacaagaggtctgtgtgccattgcccaggcagagtctctacgctacaaactcttaggagggcttgcagttcgaagggcctgctatggtgtgcttcggttcattatggaaagtggggccaagggctgtgaggttgtggtctctgggaagctccgaggacagagggccaagtccatgaagtttgtggatggtctgatgattcacagcggagaccctgttaactactatgttgacactgctgtgcgccatgtgctcctcagacagggcgtgctgggcatcaaagtgaagatcatgctgccctgggacccaagtggtaagattggtcccaagaagcctctgcctgatcatgtgagcattgtggaacctaaagatgaaatcttgcccaccacccccatctcagaacagaagggtgggaagccagagccacccgccatgcctcagccagtgcctacagcataacagggtcttggcagctgcatctggaggctggatgttgtcttgtaaagacgtttaataaaatcttgaa

SEQ ID NO: 2650 - DNA, 671 bp, Rattus norvegicus
  Genbank Accession No. X51706
ccgagaatgaagaccattctcagcaatcagactgtcgacattccagaaaatgtcgacatcactctgaaggggcgcacagtcattgtgaagggccccagaggaactctgaggagggacttcaatcacatcaatgtagagctgagtcttcttggaaagaaaaagaaaaggctccgtgttgacaagtggtggggtaacaggaaggaactggccactgtcagaaccatctgcagtcatgttcagaacatgatcaagggtgtgacactgggcttccgttacaagatgaggtctgtgtatgctcacttccctatcaacgtcgttattcaggagaatgggtctctggttgaaatccgaaatttcttgggtgaaaaatacatccggagggttcggatgaggacaggtgttgcttgttctgtctctcaagcccagaaggatgagttaatccttgaaggaaatgatattgaacttgtttcaaattcagcggctctgattcagcaagccacaacagttaaaaacaaggatatcaggaagtttttggatggcatctatgtttctgagaagggaaccgtccagcagcctgacgaatgagacctcagtttcctagcttcagaaacaagatcctgataacaagtacagtttgggctctgtggaaacaataaaagacttatatattg

SEQ ID NO: 2651 - DNA, 509 bp, Rattus norvegicus
  Genbank Accession No. X51707
cctttcccctggctggcagcgcggaggccgcacgatgcctggagttactgtaaaagacgttaaccagcaggagttcgtcagagctctggcagccttcctcaaaaagtctgggaagctgaaagtccccgaatgggtggacacagtcaagttggccaaacataaagagcttgccccatatgatgagaactggttctacacacgagctgcttccacagcacggcacctgtacctccgtggtggtgcaggggttggttccatgaccaagatctacggaggacggcagagaaacggtgtcaggcccagccacttcagcagaggctctaagagtgtggcccgccgggtcctccaagccctggaggggctgaaaatggtggaaaaggaccaagatgggggccgcaagctaacacctcagggacagagagatctggacaggatcgccggacaggtggcagctgccaacaagaagcattagaacaaaggatgctgggttaataaattgcctcattcat

SEQ ID NO: 2652 - DNA, 1197 bp, Rattus norvegicus
  Genbank Accession No. X53054
ctccttttctccagcatggtgtggctcgccagagattcctgtgtggcagctgtgatcctgctgctgacagtgctgagccctcccgtggcgttggtcagagaccccacgccacgatttttggaacaagttaaaggtgagtgtcatttctacaacgggacgcagcgagtccggtttctggccagatacatctacaaccgggaggagtacacgcgcttcgacagcgacgtgggcgagttccgcgcggtgaccgagctggggcggccctcagccgagtactataacaaacagaaggagtacatggagcagttgcgggccacggtggacacggcctgcaaacacgactacgagatctctgagagcttccttgttccgcggacagttgagcccaaggtgactgtgtacccttcaaagacgcagcccctggaacaccacaacctcctggtctgctctgtgagtgacttctaccctggcagcgttgaagtcagatggttccggaatggcgaggaggaaaaggatggactcgtgtccaccggcctgatccgaaatggagactggaccttccagttgctggtgatgctggagacggttcctcaaggtggagaggtttatacctgccaggtggagcatccaagcctgcccagccctgtcagagtggagtggaaagcacagtccacatctgcacaaaataagaagatgagtggagtcgggggcatcgtgctgggtctgctcttccttggagctgggctgtttgtctacttcaggaaccagaaaggacagtctggacttcagccaacaggactcctgaactgaggtgaggcgacaaggctgaaggaaggcgttctcccagtgtcaccatgtcttgaaacatgtcctgcttggcccacattcctccagagacagtgctctcccggacctggctcctcctgattctccaccccggagatctgtgctcctggtggctgtttagcccctggccaaaccttgcagccccggggacagaagccccctctctcaccactcctgctcccttttgtcccttgccctttgcctggcgcttctgagtcagtctgctgtcatatgctttctgacatctttctcaaataaacaaagaatgaaagtcatctacttcagagtttcaagcagaagaaataccattcatgcatagtaagcatgggggatagtgtataagaaataaat

SEQ ID NO: 2653 - DNA, 535 bp, Rattus norvegicus
  Genbank Accession No. X53378
ctctttgcttccagacctccgccatcatgggtcgcatgcacgctcccgggaagggcctgtcccagtcggcgctgccctaccgccgtagcgtgcccacgtggctgaagttgacgtctgacgacgtgaaggaacaaatttacaagttggccaagaaaggcctgactccttcccagataggtgtgattctgagggactcacatggtgtggcacaggtccgttttgtgaccggaaataaaatcttgagaatccttaagtccaaaggccttgcccctgatcttcctgaggatctctaccatttgatcaagaaagcagttgctgtcagaaagcaccttgagaggaacagaaaagataaggatgctaaattccgcctgattctaattgagagcagaattcaccggctggctcgatactataagactaagcgggtgctcccacccaactggaaatatgagtcatccacagcctctgctctggtggcataaatgctgttgcgtacacaagcaataaaatcactttgagtaaaaaaaaaaaaaaa

SEQ ID NO: 2654 - DNA, 664 bp, Rattus norvegicus
  Genbank Accession No. X53504
ctttcggttcggaggaggcaacggtgcaactttcttcggtcgtcccgaatccgggttcatccgacaccagccacctccaccatgccgcccaagttcgaccccaacgagatcaaagtcgtgtacttgaggtgcaccggaggcgaggtcggcgccacatccgccttggcccctaagatcggtcctctgggtctgtctcccaaaaaagttggtgatgacatcgccaaggctaccggtgactggaaaggcctcaggattacagtgaaactgaccatccagaacagacaggcccagattgaggtggtgccctctgcctctgccctgatcatcaaagccctcaaggagccaccaagagacaggaagaagcagaaaaacattaaacacaatggaaacatcacttttgatgagattgtcaacattgcccggcagatgagacaccggtctttggccagagaactttctggaactatcaaggagatcctgggtactgcacagtctgtgggctgcaatgtggacggccgccaccctcatgacatcatagatgacatcaacagtggtgcggtggagtgcccagctagttaagaagcaacgagaaggggttgggaatttagctcagtggtagagcgcttgccaagcccaaggccctgggttcagtccccagctccgg

SEQ ID NO: 2655 - DNA, 6335 bp, Rattus norvegicus
  Genbank Accession No. X53581
ggatcccggcccgcagcagctctctgctcccagaacccgtgagaaagagacctcaccgcctggtcaggtgggcactcctgaggctgcagagcggaagagaccaccaacactgcccacccctgcccacatccctggcccaagaggaaactgtataaggcctctgggttccgtgggggagggcccaggagcgtcaggacccctgcctgagacaccgccggaacctgagggaaacagaccggataaacagttctctgcacccaaatcccatgggagggagagctgaaccttcagagaggcagacaagccttggaaaccagaagagactgctctctgtacatacatctcggacgccagaggaaaacaccaaaggccatctggaaccctggtgcactgaagctcctggaaggggcggcacaggtcttcctggttgctgccgccacagagagcccttgggcagcaccccgcctggtgaactcaagacacaggcccacaggaacagctgaagacctgcagagaggaaaaactacacgcccgaaagcagaacactctgtccccataacggactgaaagagaggaaaacaggtctacagcactcctgacacacaggcttataggacagtctaaccactgtcagaaatagcagaacaaagtaacactagagataatctgatggtgagaggcaagcgcaggaacccaagcaacagaaaccaagactacatggcatcatcggagcccaattctcccaccaaaacaaacatggaatatccaaacacaccagaaaagcaagatctagtttcaaaatcatatttgatcatgatgctggaggacttcaagaaagacgtgaagaactcccttagagaacaagtagaagcctacagagaggaatcgcaaaaatccctgaaagaattccaggaaaacacaatcaaacagttgaaggaattaaaaatggaaatagaagcaatcaagaaagaacacatggaaacaaccctggatatagaaaaccaaaggaagagacaaggagccgtagatacaagcatcaccaacagaatacaagagatggaagagagaatctcaagagcagaagattccatagaaatcattgactcaactgtcaaagataatgtaaagcggaaaaagctactggtccaaaacatacaggaaatccaggactcaatgagaagatcaaacctaaggataataggtatagaagagagtgaagactcccagctcaaaggaccagtaaatgtcttcaacaaaatcatagaagaaaacttccctaacctaaaaaaagagatacccataggcatacaagaagcctacagaactccaaatagattggaccagaaaagaaacacctcccgtcacataatagtcaaaacaccaaacgcacaaaataaagaaagaatattaaaagcagtaagggaaaaaggtcaagtaacatataaaggcagacctatcagaatcacaccagacttctcgccagaaactatgaaggccagaagatcctggacagatgtcatacagaccctaagagaacacaaatgccagcccaggttactgtatcctgcaaaactctcaattaacatagatggagaaaccaagatattccatgacaaaaccaaatttacacaatatctttctacaaatccagcactacaaaggataataaatggtaaagcccaacataaggaggcaagctataccctagaagaagcaagaaactaatcgtcttggcaacaaaacaaagcgaatgaaagcacacaaacataacctcacatccaaatatgaatataacgggaagcaataatcactattccttaatatctctcaacataaatggccttaactccccaataaaaagacatagattaacaaactggatacgcaacgaggaccctgcattctgctgcctacaggaaacacacctcagagacaaagacagacattacctcagagtgaaaggctggaaaacaattttccaagcaaatggtcagaagaagcaagctggagtagccattctaatatcaaataaaatcaatttttaactaaaagtcatcaaaaaagataaggaaggacacttcatattcatcaaaggaaaaatccaccaagatgaactctcaatcctaaatatctatgccccaaatacaagggcacctacatatgtaaaagaaaccttactaaagctcaaaacacacattgcacctcacacaataatagtgggagatttcaacaccccactctcatcaatggacagatcatggaaacagaaattaaacagagatgtagacagactaagagaagtcatgagccaaagggacttaacggatatttatagaacattctatcctaaagcaaaaggatataccttcttctcagctcctcatggtactttctccaaaattgaccatataattggtcaaaaaacgggcctcaacaggtacagaaagatagaaataatcccatgcatgctatcggaccaccacggcctaaaactggtcttcaataacaatcaaggaagaatgcccatatatacttggaaactgaacaatgctctactcaatgataacctggtcaaggaagaaataaagaaagaaattaaaaactttttagaatttaatgaaaatgaaggtacaacatacccaaacttatgggacacaatgaaagctgtgctaagaggaaaactcatagcgctgagtgcctgcagaaagaaacaggaaagagcatatgtcagcagcttgacagcacacctaaaagctctagaacaaaaagaagcaaatacacccaggaggagtagaaggcaggaaataatcaaactcagagctgaaatcaaccaagtagaaacaaaaggaccatagaaagaatcaacagaaccaaaagttggttctttgagaaaatcaacaagatagataaacccttagccagactaatgagaggacacagagagtgtgtccaaattaacaaaatcagaaatgaaaagggagacataacaacagattcagaggaaattcaaaaaatcatcagatcttactataaaaacctatattcaacaaaacttgaaaatcttcaggaaatggacaattttctagacagataccaggtaccgaagttaaatcaggaacagataaaccagttaaacaaccccataactcctaaggaaatagaagcagtcattaaaggtctcccaaccaaaaagagcccaggtccagacgggtttagtgcagaattctatcaaaccttcatagaagacctcataccaatattatccaaactattccacaaaattgaaacagatggatcactaccgaataccttctacgaagccacaattactcttatacctaaaccacacaaagacacaacaaagaaagagaacttcagaccaatttcccttatgaatatcgacgcaaaaatactcaacaaaattctggcaaaccgaatccaagagcacatcaaaacaatcatccaccatgaccaagtaggcttcatcccaggcatgcagggatggtttaatatacggaaaaccatcaacgtgatccattatataaacaaactgaaagaacaaaaccacatgatcatttcattagacgctgagaaagcatttgacaaaattcaacaccccttcatgataaaagtcctggaaagaattggaattcaaggcccatacctgaacatagtaaaagccatatacagcaaaccagttgctaacattaaactaaatggagagaaacttgaagcaatcccactaaaatcagggactagacaaggctgcccactctctccctacttattcaatatagttcttgaagttctggccagagcaatcagacaacaaaaggaggtcaaggggatacagatcggaaaagaagaagtcaaaatatcactatttgcagatgatatgatagtatatttaagtgatcccaaacattccaccagagaactactaaagctgatagacaacttcagcaaagtggctaggtataaaattaactcaaataaatcagttgccttcctctatacaaaagagaaacaagccgagaaagaaattagggaaacgacacccttcataatagacccaaataatataaagtacctcggtgtgactttaacaaagcaagtaaaagatctgtacaataagaacttcaagacactgaagaaggaaattgaagaagacctcagaagatggaaagatctcccgtgctcatggattggcaggattaatatagtaaaaatggccattttaccaaaagcaatctacagattcaatgcaatccccatcaaaataccaatccaattcttcaaagagttagacagaacaatttgcaaattcatctggaataacaaaaaacccaggatagctaaagctatcctcaacaataaaaggacttcagggggaatcactatccctgaactcaagcagtattacagagcaatagtgataaaaactgcatggtattggtacagagacagacagatagaccaatggaatagaattgaagacccagaaatgaacccacacacctatggtcacttgatttttgacaaaggagccaaaaccatcaaatggaaaaaagatagcattttcagcaaatggtgctagttcaactggaggtcaacatgtagaagaatgaagatcgatccatgcttgtcaccctgtacaagcttaagtccaagtggatcaaggacctccacatcaaaccagacacactcaaactaatagaagaaaaactagggaagcatctggaacacatgggcactggaaaaaatttcctaaacaaaacaccatggcttacgctctaagatcaagaatcgacaaatgggatctcataaaactgcaaagcttctgtaaggcaaaggacactgtggttaggacaaaacggcaaccaacagattgggaaaatatctttaccaatcctacaacagatagaggccttatatccaaaatatacaaagaactcaagaagttagaccgcagggaaacaaataaccctattaaaaaatggggttcagagctaaacaaagaattcacagctgaggaatgccaaatggctgagaaacacctaaagaaatgttcaacatctttagtcataagggaaatgcaaatcaaaacaaccgtgagatttcacctcacaccagtgagaatggctatgatcaaaaactcaggggacaacagatgctggcgaggatgtggagaaagaggaacactcctccattgttggtgggattgcaaactggtacaaccattctggaaatcagtctggaggttcctcagaaaattggacattgaactgcctgaggatccagctatacctctcttgggcatatacccaaaagatgccccaacatataaaaaagacacgtgctccactatgttcattgcagccttatttataatagccagaagctggaaagaacccagatgcccttcaacagaggaatggatacagaaaatgtggtacatctacacaatggaatattactcagctatcaaaaacaacgagtttatgaaattcgtaggcaaatggttggaactggaaaatatcatcctgagtaagctaacccaatcacagaaagacatacatggtatgcactcattgataagtggctattagcccaaatgcttgaattaccctagatacctagaacaaatgaaactcaagacggatgatcaaaatgtgaatgcttcactccttctttaaaaggggaacaagaatacccttggcagggaagagagaggcaaagattaaaacagagaatgaaggaacacccattcagagcctgccccacatgtggcccatacatatacagccacccaattagacaagatggatgaagcaaagaagtgcagaccgacaggagccggatgtagatcgctcctgagagacacagccagaatacagcaaatacagaggcgaatgccagcagcaaaccactgaactgagaataggacccccgttgaaggaatcagagaaagaactggaagatcttgaaggggctcgagaccccatatgtacaacaatgctaagcaaccagagcttccagggactaagccactacctaaagactatacatggactgaccctggactctgacctcataggtagcaatgaatatcctagtaagagcaccagtggaaggagaagccctgggtcctgctaagactgaacccccagtgaactagactggtggggggagggcggcaatggggggagggttgggaggggaacaccataaggaaggggaggggggagggggatgtttgcccggataccgaaagggaataacatcgaaatgtatataagaatactcaagttaataaaaaaaaaaaaaaaaaaaga

SEQ ID NO: 2656 - DNA, 2674 bp, Rattus norvegicus
  Genbank Accession No. X57523
  misc_feature (1)..(2674): n = a or c or g or t
cgcggagagttccaggctgggaccggactctggacagcgcacgctcgatggctgcgcacgcctggccgacggccgccttgctgctgctgctggtggactggctgctgctgcggcccgtgctcccgggaatcttctccctgttggttcccgaggtgccactgctccgggtctgggccgtgggcctgagtcgctgggctatcctgggactaggggtccgcggggtcctcggggtcaccgcgggagcccgtggctggctggctgctttgcagccgctggtggcggcgctgggtttggccctgcctggacttgcctcgttccgaaagctgtccgcctggggagcactccgggagggtgacaacgctggactgctccactggaacagtcgcttagatgccttcgttctcagttatgtggccgcattgcccgcagctgccctgtggcacaagttggggggcttctgggcgcccagtggccacaagggcgctggagacatgctgtgtcggatgctaggcttcctggactccaagaaggggcgtctccacctggttctggttctcttgatcctctcctgccttggggaaatggccattcccttcttcacaggccgcatcactgactggatccttcaggataagacagcccccagcttcgcccgcaacatgtggctcatgtgtattcttaccatagccagtacagtgctggagtttgcaggagatggaatctacaacatcaccatgggccacatgcacagccgcgtgcatggagaggtgtttcgggccgtccttcaccaggagacaggatttttcctgaagaacccaacaggttccatcacatctcgggtgactgaggacacctccaacgtgtgcgagtccattagtgacaagctgaacctgttcctgtggtacctggggcgaggcctgtgtctcctggcgttcatgatttgggggtcattctacctcactgtggtcaccctgctcagcctgcctctgcttttccttctgcccaggaggctggggaaagtgtaccagtcactggcagtgaaggtgcaggagtctctagcaaagtccacgcaggtggccctcgaggccctgtcggcgatgcctaccgtacggagctttgccaacgaggagggagaggcccagaagtttaggcagaagttggaagaaatgaagccgctaaacaagaaagaggccttggcttacgtcactgaagtctggaccatgagtgtctcgggaatgctgctgaaggtgggaattctgtacctcggtgggcagctggtggtcagaggggctgtcagcagcggcaacctcgtctcctttgttctctaccagcttcagttcaccagggccgtggaggtcctgctctccatctatccctccatgcagaagtccgtgggcgcttcggagaaaatattcgaatacctggaccggactccctgctctccgctcagtggctcactggcacctttaaacatgaaaggcctcgtcaagttccaagatgtctcctttgcctacccaaaccatcccaacgtccaggtgcttcaggggctgacttttacgctgtatcccgggaaggtgaccgccttggtgggacccaatgggtcagggaagagcaccgtggccgccctgctgcagaacctgtaccagcccaccgggggcaaggtgctcctggatggcgagcccctggtccagtatgatcaccactacctgcacacgcaggtggccgcagtgggacaagagccactgctatttggaagaagttttcgggaaaatattgcctatggcctgacgcggactccaaccatggaggaaatcacagctgtggccatggagtccggagcccacgatttcatctctggattccctcagggctatgacacagaggtaggtgaaactgggaaccagctgtcaggaggtcagcgacaggcggtggccttggctcgagccttgatccggaagccacgcctgcttatcttggacgatgccaccagtgccctggatgctggcaaccagctacgggtccagcggctcctgtatgagagccccgagtgggcctctcggacggttcttctgatcacccagcagctcagcctggcagagcgggcccaccacatcctcttcctcaaagaaggctctgtctgcgagcagggcacccacctgcagctcatggagagaggagggtgttaccggtccatggtggaggctcttgcggctccttcagactgacgggcttctggactgcaagctgcgcgagtccctccccctgctgtcctctgctctgtgtggcggagaacctgggagcaaagattttaccacatccacggagatagttgaggagcgatggtgtttgttacatgaggaaaatgtaacctctaggagatgcccggaatttaccacnaatgttttcccgccccgccccctgttagacgggggatgggggtaggtaccccaggctaacactgagctgctgagtctcctgtctcccgtggagtttgcatcacggcatgcgcccacaaacctggcttatgtggcgttgggacagaatgagaagaaacgctcaaaatgtacagagaaggggcaaatagcttgcaattaaccaaaggcataggctggcctatgggtgttccgcgggttcttgatatttataataaaactggtgttttgtaaaaaaaaaa

SEQ ID NO: 2657 - DNA, 516 bp, Rattus norvegicus
  Genbank Accession No. X57529
cacaggaggcctacacgccgccgcttgtgccgccgccatgtccctagtgatccccgagaagtttcagcacatcctgcgagtactcaacaccaacatcgatgggcggcggaaaatagccttcgctatcactgccattaagggtgtggggcggagatacgctcatgtggtgttgaggaaagcagacattgacctcaccaagagggctggggagctcacggaggacgaggtggagcgtgtgatcaccatcatgcagaacccacgacaatacaagatccctgactggttcttgaacagacagaaggacgtgaaggatgggaagtatagccaggttctggccaacggtctagacaacaagctgcgtgaggacctggagcggctgaagaaaatccgagcccatagaggactgcgccacttttggggccttcgtgtccggggtcagcacaccaagaccactggccgcaggggccgtactgtgggtgtgtccaagaagaaatgagtctttgggcctttgctgtt

SEQ ID NO: 2658 - DNA, 499 bp, Rattus norvegicus
  Genbank Accession No. X58200
ctctttccggacgctcaagatgtcgaagcgaggacgtggtgggtcctccggagcgaaattccggatttccctgggtcttccggtaggagctgtgatcaactgtgctgacaacacaggagccaaaaacctgtatatcatctctgtgaagggaatcaagggacggctgaacagacttcctgctgctggtgtgggcgacatggtgatggccacagttaagaaaggcaaaccagaactaaggaaaaaggtacatcctgcagtggtgattcgacaacgaaagtcatatcgaagaaaagacggggtgttcctttattttgaagataatgcaggggtcatagtaaacaataaaggcgagatgaaaggttctgctatcacaggtccagttgcaaaggagtgtgcagacttgtggcccaggattgcatccaatgcaggaagcattgcctgattctccagtgtgtttgtaaaatatattcattaaagtcttctctctgaaaaaaaaaaa

SEQ ID NO: 2659 - DNA, 744 bp, Rattus norvegicus
  Genbank Accession No. X58465
ctcttcctgtctgtgccagaactgcgcgtggtccgcgccgatcgactgagaagcccggtttgcgctctcagaatgactgaatgggaaacagccacacccgcggtggcagagaccccggacatcaagctctttgggaaatggagcactgatgatgtgcagatcaacgatatttctctacaggattacattgctgtgaaggagaagtatgccaagtacctgccccacagtgcaggacggtatgctgccaacggtttccgcaaagcacagtgtcccatcgtggagcgccttactaactccatgatgatgcacggtcgtaacaacggcaagaagctcatgactgtacgaattgtcaagcatgcctttgagatcatccacctgctcactggtgagaaccctctgcaggtcctggtgaatgctatcatcaacagtggcccccgagaagactcaacacgcattgggcgggctggaacagtgagacggcaggctgtggatgtatccccacttcgccgagtgaatcaggccatctggctgctgtgcacgggggctcgtgaggctgctttccggaacatcaagaccatcgctgagtgccttgcagatgagctcattaatgctcgcaagggctcctccaactcctatgctatcaagaagaaagatgaactggagcgtgtggccaagtctaaccgctgatttcccagctgctgcctaataaattgtgtgccctttgggacagttacatcaaaaaaa

SEQ ID NO: 2660 - DNA, 497 bp, Rattus norvegicus
  Genbank Accession No. X59375
aaagttgctgctaggcgctcgaaagcgagcacctcatctcagagatctggagcggccgcgcttgcggagctgtcaccatgcctctggctagagatctattacacccttccttggaagaggaaaagaaaaaacataagaagaaacggctggttcagagcccaaattcttacttcatggatgtgaaatgtccaggttgctacaagattactacagttttcagccatgctcagacagtggttctttgtgtgggttgttcaaccgtgctgtgccagcccacaggagggaaagccaggctcacagaaggctgttcatttagaagaaagcaacactaatcatctatacaagttcctgaattcgtgtttttcacagaaagccttatcaactttagttactctaccaagacaatgtaattattgtttgattttataaagtctacaacaatgatctcctattttggtgtcagtttttcaataaagttttacttatgaacaagttca

SEQ ID NO: 2661 - DNA, 3996 bp, Rattus norvegicus
  Genbank Accession No. X59864
  misc_feature (1)..(3996): n = a or c or g or t
aacggatcaaggccagactgtgaggtaacaaataaaactcaccgcagagagtactgatgaatgtgatggccagaaaagtgacagtgaggagcacccaaattagccacctcgttgaaaccactgtggccagacaaggtcagtcaagcagactgggacaaaggctgagggttgaccactgataagctgttgatactgcctgggacagtatgagacccctgcccccaaattcctgttggggtcattacacaagctgagtagtaggcagcttcaatgtggcagggtgctggccactgttccatgaaggactccagtaggctaggctacggggctatatgttctctcgacctcaagggagatatttttgggacaacgccaggccctgtctaagggattccaaagtgggagttgtggtgaggctgtctttggagaatttcaggacgagtgcgggtgcggggtgaggcgaacgtgcgctggaaagatccagggtggaggtggctgcgggggctggcgggtccttgtactgttggttgacagagtaggggcgggaattcgggcggccaacgtccagttagaaaaagcccgggctagagggcccgaagcaccgggtgtgggaggggggtggggggtgggggtggggggtaatggggaaacnggggaagatgggagtgctggaggagagttgtggggtccgaggagcacctcgcatctggagtctggcaggagtgttgaaggactgaggggctagctcgggcagggcaaaggcagcaggacctgggaggaaggagcatggtgtggttcccaggcattgcagaggctggaaaacatcggtgtggggttgaagggcctgagctagggttggagaggaacggggagccagacattcatcccggtcacttttggttacaggacgtggcggctggtcggatacaggggagctgctgggaagggttcgaccccagacctgggcagtgaaggtgtagctggcagcggtgggcaggtgaggaccgccgtctgctgggcaggtgagtctccttcttctctcttggcctcgctgactgaccttctaaaaggtttagagagcgaggccgctgagaagaagcagctgacctcccaacagaatggcacatagaaaggcaggacagttagcaaaggagacatcgtctcggggggagccgagacagaacaaggctgggggaccattgggcaccccggagtggaaagagcttttagagagaagatagaagaggtgcagggctgccagtcaagactgaggctgctgcctccaggcaagtgataggaggccttggagacagtggcagagactatgggatccagcaagagcagaagcattctaggctggggtcaaacagggcaagatgggggtcacaggacacagatgggtccccagccgccaccacatcccacccaccgtaattcatttagaagcaggttcaagagtggctctggcagggcttctgaggctttgccagagcttcgatggccggagaacgggaaagaagggcagtgcagggtgtcaacaggaagggaacgggggctgcaggtatcggactccagagggattttacagcaaggaggctgcagtgggtccagcctgcagacacaccattcccatgaggcactgcggcccagggactggtgcggaaagggcccacagtggacttggtgcactgtatgccctaaccgctcagtccctgggtctggcatgacagacagaacatttccaggggagtcaagggcacaggatgaagccagacaaggcgaggcaggtggggcagaatgaatgagctttctagggagggaggttgggtgcaggtagagcgaggtaaagcagctggggtggtgagccagcgaggcactggcctccagagtccgtggccaaggagggcttgcgggcggcgacggagcagtgatcggtgtctcggagagctcggactggagactagggtaagtgtctgtcccactagtggccacccagtttcctcccactcaagtccacttaactcatgtcttcttttctccccacagccaggtctctagcagaagtggatgtgcctgccagtcactgaaggcgaggatgacaggtgtggtcaacgtgatagaaagacatgacatggtccggtgtgatggagaggacagaaggacagtcatccagccttcctggtgagcatactccctgccacagggctagcccgctcaaccacctaatttgtcacccactcactccagattctgtcctttgcagaacaccgtgggctggtgccgtgggacactgccgtagaagccgtctgttctttcctttgcccaaagagctaacacatctctgctgctctctggatcctcttccccctaccttgaaccctcaagatgaaaggtgaggatctcctgccccacatgggctaggtggcaggctgcaagtgcaggggtctcattctctcccacccacagaaatggtgctacccagctcatgtctgggcctttgaatccggggacttctttaagtccgtctagttctgaatcaagaatatgctgcactcagaaccactacactacctgcctcaggaatcggctcgaaggtgagtcagggcgccctttggcagctcggcaagcctactccaagcctactctccctccccacatcccctcaggccccctccccctgcccagcccccctcatttgtcttttttctctttgcaggtaaagctgaaggaacagacggtgacaacatcttgaaagagcagacccacacagcacccacccacccctgagactccatcttcatggccaactaactctgcctggcccgggagaccaccacccacatcatcctggagccaagcctctagcccgggatgacttcatcatctccctcctgtcttttttcttcttcctcctttcctgtaactctatatttctttccttttgttccttctctgcttgagagactcaaagcatccgtgactctgctcccccactcaccccttttgaatttgcactaagtcgattgcactggtttggagtcccggagatagcctgagtctctccgtatggatgtatacagcgagtgtgtaggcccctttggctatgttgccccagtgcccgcccgtcatccacttctgtctgagggcaactgggtgtggccgtgcgcttgaggcctcaccttccccttgcctagtctggaagcagttccatcataaagtgttcaacgcaccttccttcatcctttgtccctcctcaccagggcctcaccagaggtcctgggtccaccaataaatacagttacagtcattggtctcgtgcacttgaatataatgcgactcacttggggggctggggggcaggggaaagaaatgagggaaggggaataaaagggatggggtacagcacccataatgaaggggattatgaagtagggggcatctaggatggaatgaagaataggagatgggaggggcttatgaaaaggacggtggcattgggatgggaggccatgggagggggctcatgagataccaagaagctacagtatggaaggggcctatgaatatgaaatggtgcctaaggaatgagcagcgcagtagacatcacagtggagagtggcagagtgccatgaggagacagaggcaaggctgtgaggagggtccctcaagactggggaggtgaaggacagacatccttagcaatgagagagtggtggcctgaccagaaacctggattctacactgctgccagtcctgtctggatgactccccgagtcctcacacttatcccaactcctgaagcctactgtcaactgcaaagtgaacctgactcccgactcctcgcagaggctgctaatgaggtagacagctatatgtgaggctgggtagaccacagccacataaaggagcccatggtggcccctgggcttccctctcctgctctgagcatgctcagctctggactggagcccacggtagatgcctgcagtggtacca

SEQ ID NO: 2662 - DNA, 631 bp, Rattus norvegicus
  Genbank Accession No. X60212
ctgttagcggccagaggtgacctgtgaagatggttcgctactcccttgacccagaaaaccccacgaaatcatgcaagtcaagaggctcaaaccttcgtgttcactttaagaacacccgggaaactgcccaggccatcaagggtatgcatatccgcaaagccaccaagtatctgaaggatgtcactttaaagaagcagtgtgtgccattccggcggtataacggtggagttggtaggtgcgcccaggccaaacagtggggctggacacagggacggtggccaaaaaagagtgctgaatttttgctgcacatgcttaaaaatgcagagagtaatgctgaacttaagggtttggatgtagactctctggtcattgaacacatccaggtgaacaaggctcctaagatgcgcagacggacctacagagctcacggccggattaacccatacatgagctccccctgccacatcgaaatgatcctcactgagaaggaacagattgttccaaagccagaagaggaggttgcacagaagaaaaagatatcccagaagaaattgaagaaacaaaagctcatggcacgggaataaattcagcataaataaatgcggataaagtaaaaaaaaaaaaaaaaaaa

SEQ ID NO: 2663 - DNA, 2464 bp, Rattus norvegicus
  Genbank Accession No. X60468
  misc_feature (1)..(2464): n = a or c or g or t
ttcttctcgaccttgggtcttggaaggggactggccctctactggatgattattgggtaggctgacccctcactgagcctcctacctggcagattccttctggaaccccaacgctttcgagacggattccgatctaccggctggatggatgagggtccaagacacctcagggacctactactggcacatcccaacagggaccacccagtgggaacccccaggccgggcctccccatcacaggggaacagtccccaagaagagtcccaggtaaggctcaatggcttgttgcacaccaggggtggaagggtctgtgcttctagaacagggtgaaactaccaccctacacccattcttcctccagctcacctggactggctttgctcaccaagaaggctttgaggaaggagagttttggaaggtaaataaagaaaccacgttcactctgggggctactggagagggggacttcattttgggcttgattctttaatttgttttcaaaggatgaacctagtgaagaggccccaatggagttgggactgaaggaccctgaggaggggacattgcccttctcagctcagagcctcaggtgagtcagatgcagcagactagggtgagactggatctatgtttcttaaactaagagtgctgtgtcaagtgttcccatctgcctccagcccagagccagtgccccaggaggaggagaatctgccccaacggaacgccaatccagggatcaaggtttgttcaagaccaacacccatttagtaagcaggcctctatgtggaggacagacctcatgctgtgctttgaggacatctgtggtcttagcatatctcccaagcaagttcttaccagtttcaggcaaggccgtgtgtatgctgaactgtcttctgacagcttctgtgtttaactcagttgcgaagggcctcttagggactcttaaggcttagatcagcaggccatctcttctgaccatgtcttgtttggggaccttccatctaagttcagaatgtctcacatgttttatgtgccaggtcnngagctcctctgtgctgtgcccaaggcacctccaattccatctcagatctctaccccggacccttttctgtgtctggcagtgtttcgctgtgcgctccctaggctgggtagagatgactgaggaggagctggccccaggacgcagcagtgtggcagtcaacaattgtatccgccagctctcctaccacaaaaacaatctacatgatccgatgtctggaggctggggagaggtagggctggactgtgagtgtgtactgggcccactagggtaccactgagtcccacctcctgggtttgcagggaaaggatctgctgctccagctggaggatgagacgctaaagttggtggagccacagaaccagacactgctgcatgcccagcccatcgtcagcattcgcgtgtggggcgttgggcgggacagtggaaggtgggcacaggaatcgccggggtgggggaggctcatccatccagcagttagtcctttttctaatcatgctctttggctctcttgtgctgccggacccagagagaggtattaacgtccatctgctttgactgtgccccttcctactcctggaccggatgcttcgaagcacctaggctcccttactgtgtgccctgccccttcctcacctgctgtcctgggccttatcccccacctcagcatgcttgcctctgcgctccccagctcctgaaggcagacctacggaacaccagggcaaaccctgtacactgtcatggacagggaggttgagggtggaatggtggccaggcatgcgatttggtggttctaggagacactgaggtgaccctccccccaaacagggactttgcctacgtagctcgagataagctgacccagatgctcaagtgccacgtgtttcgctgtgaggcacctgccaagaacatcgccaccagcctgcatgagatctgctccaaggcacggccccctccatccctgaactagctgtcatctttgctctagaaggtgtggtaggttgcgttgtggatgtaggtgggcttcgggcaatgtagctctaacagagcacacacaccccccccattcattcctcagatcatgtctgaacggcgcaatgctcgctgcttggtaaatggactctccctggaccactctaaacttgtggatgtccctttccaaggtgagtaccacacgcagcctcataaggcacagctcagctttgttagttaaggtgaggtgacccaagaagaggcacaggatcctgggcaggcatgagcacatggagatgggtgcttgacagtacataagtggataagcttgtagagggaggcaggggagaagtgggcgtgagggttggactaggaaaatgcatagttcatgctttagtgtcaggacctagaacagtgagcctctttttctttttcttctcacagtggaattc

SEQ ID NO: 2664 - DNA, 1542 bp, Rattus norvegicus
  Genbank Accession No. X61295
catccaccatgatcaagtaggcttcatcccaggcatgcagggatggtttaatatacggaaaaccatcaacgtgatccattatataaacaaactgaaagaacagaaccacatgatcatttcattagatgctgagaaagcatttgacaaaattcaacaccccttcatgataaaagtcctggaaaaaataggaattcaaggcccatacctaaacatagtaaaagccatatacagcaaaccagttgctaacattaaactaaatggagagaaacttgaagcaatcccactaaaatcagggactagacaaggctgcccacgctctccctacttattcaatatagttcttgaagttctagccagagcaatcagacaacaaaaggagatcaaagggatacagatcggaaaagaagaggtcaaaatatcactatttgcagatgatatgatagtatatttaagtgatcccaaaagttccaccagagaactactaaagctgataaacaacttcagcaaagtggctgggtataaaattaactcaaataaatcagttgccttcctctatacaaaagagaaacaagccgagaaagaaattagggaaacgacacccttcataatagacccaaataatataaagtacctcggtgtgactttaaccaagcaagtaaaagatctgtacaataagaacttcaagacactgaagaaagaaattgaagaagacctcagaagatggaaagatctcccatgctcatggattggcaggattaatatagtaaaaatggccattttaccaaaagcaatctacagattcaatgcaatccccatcaaaataccaatccaattcttcaaagagttagacagaacaatttgcaaattcatctggaataacaaaaaacccaggatacgtaaagctatcctcaacaataaaaggacttcagggggaatcactatccctgaactcaagcagtattacagagcaatagtgataaaaactgcatggtattggtacagagacagacagatagaccaatggaatagaattgaagacccagaaatgaacccacacacctatggtcacttgatttttgacaaaggagccaaagccatccaatggaaaaaagatagcattttcagcaaatggtgctggttcaactggagggcaacatgtagaagaatgcagatcgatccatgcttatcaccctgtacaaagcttaagtccaagtggatcaaggacctccacatcaaaccagacacactcaaactaatagaagaaaaactagggaagcatctggaacacatgggcactggaaaaaatttcctgaacaaaacaccaatggcttatgctctaagatcaagaattgacaaatgggatctcataaaactgcaaagcttctgtaaggcaaaggacactgtggttaggacaaaacggcaaccaacagattgggaaaagatctttaccaaccctacaacagatagaggccttatatccaaaatatacaaagaactcaagaagttagaccgcagggaaacaaataaccctattaaaaaatg

SEQ ID NO: 2665 - DNA, 498 bp, Rattus norvegicus
  Genbank Accession No. X61381
tgtgtgcgatcgcggtggatcgctaccatgaaccacacttctcaagccttcgtgaacgctgccactgggggacaacccccaaactacgaaagaatcaaggaagaatatgaggtgtctgaactgggggctccccacggatcggcttctgtcagaactaccgtgatcaacatgcccagagaggtctctgtgcctgaccatgtggtctggtccctgttcaatacgctcttcatgaacttctgctgcctgggcttcattgcctatgcctactctgtgaagtctagggatcggaagatggtgggtgatatgactggagcccaggcctacgcatccactgccaaatgcctgaacatcagctccctggtcctcagcatcctcatggtcattatcactattgttactgtcgtcatcattgctcttaatgctcctcgtctccagacttgatagaggattctggtttctgatcctgacgtgcttcacgctctgctggctgcccttttt

SEQ ID NO: 2666 - DNA, 843 bp, Rattus norvegicus
  Genbank Accession No. X62145
ctcttttggccttgcttgccggcagactcgccgccatgggccgtgtgatccgaggccagaggaaaggtgccggttctgtgtttcgtgcgcacgtgaagcaccgtaagggagccgcgcgtctgcgtgctgtggacttcgcggagcgacacggctacattaaaggcatcgtaaaggacatcattcatgaccctggccgcggcgctcccctcgcgaaagtagtctttcgtgatccctatcgattcaagaagcggacagagctgttcattgccgcagagggaatccacactggacagtttgtgtactgcggcaagaaggcccagctgaatattggcaatgttttgcccgtgggcaccatgcctgagggtactatcgtgtgttgtctggaggagaagcctggggacaggggcaagctggcacgagcctccgggaactatgctacagtcatctcccacaacccagagaccaagaagacccgagtgaagctgccttcagggtccaagaaggtcatttcctctgctaaccgagctgttgttggtgtcgtggctggcgggggcagaattgacaagcctatcttaaaggctggccgtgcctaccataagtacaaggcaaagaggaactgctggccacgtgtgcggggtgttgccatgaatcctgtggagcatccctttggcggtggtaaccaccagcacattggcaagccttccactatccgaagagatgccccagctgggcgcaaagtgggtctcattgctgctcgccggactggacggctacgtggaaccaaaactgtacaggagaaggagaactagagttcaggagctaataaagtatgtgctttggcta

SEQ ID NO: 2667 - DNA, 1316 bp, Rattus norvegicus
  Genbank Accession No. X62166
cgagacatatcggcggcgtgtggcggcgagatgtctcacaggaaattctcagctcctaggcatgggtccttgggcttcttgcctcggaagcgcagcagccggcatcgtggaaaagtgaagagcttccctaaggatgacccttccaagcctgttcacctcacagccttcctagggtacaaggctggcatgacccacattgtccgggaagttgaccggccaggatctaaggtgaataagaaagaagttgtggaggctgtgaccattgtggaaaccccacccatggtggttgtgggtattgtgggatatgtagaaaccccacgaggcctccggaccttcaagactgtatttgctgagcacatcagcgatgagtgtaaaaggcgtttctataagaattggcacaaatctaagaagaaggcttttaccaagtactgtaagaaatggcaagatgacacaggcaagaagcagctggagaaggacttcaacagcatgaagaagtactgccaggtcatccgcataattgctcacactcagatgcgcctgcttcctctgcgccagaagaaggcacacttgatggagatccaggtgaatgggggcactgtagctgagaagctagactgggcccgagagaggctggagcagcaggtccctgtgaaccaggtgtttgggcaagatgagatgattgacgtcatcggcgtgacaaagggcaaaggctacaaaggggtgaccagtcgttggcatacaaagaagctgccccgaaagacccacagaggtctgcgcaaagttgcttgtattggagcttggcatcctgcccgtgtagccttctctgtggctcgagctgggcagaaaggctaccatcaccgaacagagatcaacaagaagatttacaagattggtcaaggctacctcatcaaggatggtaagctgatcaagaacaatgcatctactgactacgacctgtctgacaagagcatcaacccactgggtggctttgtccattatggtgaggtgaccaatgacttcatcatgctcaaaggctgtgtggtgggaaccaagaagcgagtgcttactctccggaagtccttgctggtccagaccaagcgtcgggctcttgagaagattgacctgaagttcattgacaccacctccaaattcggacatggtcgcttccagaccatggaggaaaagaaagcattcatgggaccgctcaagaaagatcgcattgccaaggaggaaggtgcctgatgccaggagtactttgtgcagctggtggggtctcatcaataaaatattttcaattaaaaaaaaaaaaaaaaaaa

SEQ ID NO: 2668 - DNA, 466 bp, Rattus norvegicus
  Genbank Accession No. X62482
tgtggctgcagtggtccacactactctctgagtttcgccatgccgcccaaagacgacaagaagaagaaggatgccggaaagtcggccaaaaaagacaaggacccagtaaataaatctggtggcaaggccaaaaagaagaagtggtccaaaggcaaagttcgggacaagctgaacaatctcgtcctgtttgacaaagctacttacgacaaactttgtaaggaagttcccaactataagcttattactccagctgtggtctccgagagactgaagattcgaggttccttggccagggcagcccttcaggagctacttagtaaaggacttatcaagctggtttcaaagcacagagcccaagtaatttacaccagaaacacaaagggtggagatgccccagctgctggtgaagatgcataaacagattgaatcagctgtacatttgggaaaataaaactttattgaatca

SEQ ID NO: 2669 - DNA, 893 bp, Rattus norvegicus
  Genbank Accession No. X62660
ccaataaggaaactctgaaccaggagtcatggaagtcaaacccaagctctactactttcaaggcaggggaaggatggagtcgatccgctggctgctggctacagctggagtggagtttgaagaagaatttcttgagacgagagaacaatatgagaagttgcaaaaggatggatgcctgctttttggccaagtcccattggtggaaatagacgggatgctactgacacagaccagagccatcctcagctacctggccgccaagtacaacttgtatgggaaggacctgaaggagagagtcaggattgacatgtatgccgatggcacccaggacctgatgatgatgattatcggggctccatttaaagcccctcaggaaaaagaagagagcctagctttagcagtgaagagggctaaaaaccgttacttcccagtgtttgaaaagattttaaaagaccatggagaggcatttcttgttggcaaccaactcagttgggcagacatacagctactagaagccattttgatggtggaagaagtcagtgctcctgtgttgtctgacttccctctgctgcaggcatttaagacaagaatcagcaacattcctacaattaagaagttcctgcaacctggaagtcagaggaagccacctccggatggccactatgttgacgtggtcaggaccgtcctgaagttctagtgacagcgtgctttaaagtggctactgcaagggtccaatcacagcagcagctacagagcattccagaggcaagatagagctctcaggagtaaaggtcttcaaagaacctgaaaaccactctgtccaacaatgacaaatgccaattaaatagagtgaaaaactgttaaaaaaaaaaaaaaaaaaaaaaaaaaaaaaa

SEQ ID NO: 2670 - DNA, 1508 bp, Rattus norvegicus
  Genbank Accession No. X63594
cccaactgccagcagcctgcaccctgcacccgctcagctccgcacagccatgtttcagccagctgggcacggccaggactgggccatggagggcccgcgggacggcctcaagaaggagcggttggtggacgaccgccacgacagcggcttggactccatgaaggacgaggattacgagcagatggtgaaggagctgcgggagatccgcctgcagccgcaggaggcgcctctggctgccgagccctggaagcaacagctcacggaggacggagactcgttcctgcacttggcaatcatccatgaagagaagacactgaccatggaagtgattggtcaggtgaagggagacctggccttcctcaacttccagaacaacctgcagcagactccactccacttggctgtgatcaccaaccagccaggaattgctgaggcacttctgaaagctggctgtgatcctgagctccgagactttcgaggaaatacccctctccatcttgcctgtgagcagggctgcctggccagtgtagcagtcttgactcagacctgtacgccccagcatctccactccgtcctgcaggccaccaactacaacggccacacgtgtctacacttagcctctatccatggctacctgggcatcgtggagcacttggtgactttgggtgctgatgtcaacgctcaggagccctgtaatggccggacagccctccaccttgcagtggacctgcagaatcctgacctggtctcgctcctgttgaagtgtggggctgatgtcaacagagtaacctaccagggctactccccctaccagcttacgtggggccgcccaagtacccggatacagcagcagctgggccagctgaccctggaaaatcttcagacgctgcccgagagtgaggatgaggagagctatgacacggagtcagaattcacggaagatgagttgccctacgatgactgtgtgtttggaggccagcgtctgacgttataagaggaaagtggccaaaggaacgtggacttgtatatttgtacaaatagagttttatttttctaaaaaaaaaaaaaaaaaagaaaaagaaaaaaaataagaaaggatacttagcaccacagcacacagcgcctagccccgagcattctattgtggtgattcagctgttgttcttctcaaatttggggaaacagatcattgaaattcaaaggaaatgtctcctaaggttcatgtttgtgggattttttttttttttttgaggtgattttccagaatctgataaaaggaccacatttaatttatgtgcttttggttgaaccgccatagacgtagctgaccccagttgccctctacgtaagaaccaggtcgatagtggtatgtgcttaagcaccccagctgagatttgtaccactttcttgtaaatgttgtatatggatgtattttgttggtaattatttttggtacttctaagatgtatatttattaaacagatttttacagtatcaaaaaaaaaaaa

SEQ ID NO: 2671 - DNA, 534 bp, Rattus norvegicus
  Genbank Accession No. X65228
ccttttttcgccaagatggcgccgaaagcgaagaaggaagctcctgcccctcccaaagccgaagccaaagcgaaggccttgaaagctaagaaggcagtgctgaaaggtgtccacagtcacaaaaagaagaagatccgaacgtcacccactttccggcggcccaagaccctgcggctccggaggcagccaaaatatcctcgaaagagtgcacccaggagaaacaagcttgaccactatgctatcatcaaattcccactgaccaccgagtcagctatgaagaaaatagaggacaacaacacgcttgtgttcattgtggatgttaaggccaacaagcaccagatcaaacaggccgtgaaaaaactctatgatatagatgtggccaaagtcaatactctgatacggcctgacggagagaagaaggcatatgttcgcttggctcctgattatgatgctctagatgttgccaacaagattgggatcatctaaagtgagtccagatggttaattctaaatatatactttttttccaccata

SEQ ID NO: 2672 - DNA, 1526 bp, Rattus norvegicus
  Genbank Accession No. X67877
ctctcctgaccctgcgcgccgcgggaagatggcgcttgaagctggcgacatggaagagggacagctttccgactcggattccgacatgacggtcgtccccagcgataggcctctgcaaatggcgaaagtactaggtgggggcggtgctgcatgcgcaccagtgtcaaactatcggactgttaaacatgtggactccagtgaggagagtctggattccgatgacgattgctctctttggaaacgtaagcggcagaaatgtcacagtcctcctcccaagccagagcctttcccatttggacagagcggtcagaaacaagctctcaacggtgggaagaaggtgaacaacatctggggtgctgtgctacaggaacagaaccaagatgctgtggccactgagctcggcatcttgggaatggaaggcaccatcgacagaagcaggcagtctgagacctataattatttgcttgctaagaaacttgctaagaaggaatctcaagagtatacaaaagaattagacaaagatctggatgagtatatgcatggcgacaaaaaacctgggtcaaaggaagaggagaatgggcaaggtcatctcaaacggaaacggcctgtccgagacagactgggtaacagagtagaaatgaactacaaaggccgctacgacatcacagaggaggattctcccgagaaagtggctgatgagattgccttcaggttacggaaccgaagaaggacctgatagcccgagtagtgacgatacttgggaacaaaaaggccattgaacttctgatggagacggctgaggttgagcaaaatggtggccttttcataatgaatggaagccgaaggagaacgccgggtggggttttcctcaatctcctgaagaacacgcccagcatcagcgaagagcagatcaaggatattttctacattgaaaatcaaaaagaatatgaaaataaaaaagctgctagaaaaagaagaacacaactattggggaagaaaatgaaagaagctattaaaagtctaaatttccaggaagatgatgacacatctcgagaaacgtttgcaagtgacactaatgaggccctggcctctcttgacgaagcccaggaaggacccggtgaaaccaagctggatgctgaggacgccatcgacgtggaccaccctcaggatttggacatcttttaagcacactttggacattttgaagcaataaacctttgttttttaaaaaaggtgttaccaatttctactgaggttgctttactgtgcaccgacactgaggcgggagagctgtgtctgtgctcccgtgaagtagtaatgtatgtggtagtcgtgccgtcgccgcagtgtggaaggtggctgcatctgacggctgctgtacagcacgggctaatttctctactctgcatgtgctgactgttagcctacgtggagctgtgtcctctctgtccagctcactgtttcatgccagtaagacattttggttttctcattcatctttgtggtgaactatgctttggttttaa

SEQ ID NO: 2673 - DNA, 3227 bp, Rattus norvegicus
  Genbank Accession No. X68101
taagctgtcacgtggacatagtccactcatgaagaaagtttttgatgtctacctgtgtttcctccaaaagcatcagtcagaaatggctttaaaaaatgtcttcactgccttaaggtcattaatttataagttcccctcaacgttctacgaggggcgggcagacatgtgcgcatctctgtgctatgaggttctcaagtgctgtaactccaagctcagctccatccgcaccgaggcctcccagctgctctacttcctgatgaggaacaacttcgactacacagggaagaagtcttttgtccggacacacttacaggtcatcatctctctcagccagctgatcgcagacgtggttggcattggaggaaccagattccagcagtccttgtctatcatcaacaactgtgccaatagcgaccggctcattaagcacaccagcttctcctctgatgtgaaggatttgaccaagaggatccgcacagtcctgatggccacagcccagatgaaggaacatgagaacgacccagagatgctggtggacctgcagtacagcctggccaagtcctacgccagcacccctgagctcaggaagacatggctggacagcatggcaaggatccatgttaaaaatggggatctctcagaggcagcaatgtgctatgtccacgtgacagctttggtagcggaatatctcacacggaaagaagctgacctagcactccagcgggaaccacctgtcttcccctacagccatacctcctgccagaggaagagccggggaggcatgttcagacaggggtgcacagccttcagggtcatcacaccaaacattgatgaagaggcttccatgatggaagatgtcggcatgcaggatgtccatttcaatgaggatgtgctgatggagctgctggagcagtgcgcagatggactttggaaggcagagcggctacgagctggattgctgacatctataaactcatcatccccatctatgaaaagcggagggactttagagactacccacctgtatgacaccctgcaccgcccatacagcaaagtgacagaggtcatcactcgggccgcaggctcctgggacctacttccgggtggcctcttcggacagggattcttcgaagatgaagacgggaaggaatacatctacaaagagcccaaactcacgcctctgtcagagatttctcagagactccttaaactttactcggataaattcggttctgaaaatgtcaaaatgatacaggattctggcaaggtcaacccgaaggatctggattccaagtttgcttacatccaggtgacccatgtgaccccgttctttgatgaaaaggagttacaggagaggaaaacagagtttgaacgatgtcacaacatccggcgcttcatgttcgagatgcccttcacccagactgggaagaggcagggtggcgtggaggagcagtgtaagcgacggaccatcctgacagcaatacactgcttcccctatgtaaagaagcggatccctgtcatgtaccagcaccacactgacctgaaccccattgaggtggccatcgatgaaatgagcaagaaagtggccgagctccaccagctgtgttcctcagctgaagtggacatgatcaaactgcagctcaaactgcagggcagtgtgagcgtccaggtcaatgctggcccgctagcatacgcccgagccttcctcgatgacaccaacacaaagagataccctgacaataaggtgaagctgctgaaggaagttttcaggcaattcgtggaagcttgtggccaagccttggcagtgaacgaacgtctgattaaagaggaccagctggagtaccaggaagagatgaaagccaactacagggagatccggaaggagctctccgacatcatcgtgccgagaatttgccctggagaggacaagcgtgctaccaaattccctgcacatcttcaacgccatcagcgggacaccaacaagcacagtggttcaagggttgaccagttcatcctcagttgtgtgactttacctcatgaaccacacgtggggacatgctttgtcatgtgcaaactcaggacgactttcagagctaatcactggttttgccaagcacaggaagaagccatggggaatgggagagagaaagagccctggactgtgatatttaatagcagattttataggagttgggggaaggtgcacatatttttttaaatctcactggcaatgtttagttttcctcatgtcttaacaggtgtatgtggatactcttgggctgcagttcaattttattcttcttacagtatagtattaaaataaatggtctaaaggaaaagagggaaagtatgctgggacacctgtagcaggtgtgctgggacacctgtaccagctgtgctgggacacctgtaccagctgtgctgggacacctgtagcagatgcagcagcactgaacctgggaatggggactaagctggaaaaatcttgaaaatatttttctccctgtggcacattcaggttgagtacaagaactatttttgtgtctagttttgaagactgaaaggaattgactattgagattttttactagtgaatgcggagacttagagcctttatatccatgccttgtgttgacaacatgagcacttccgaagctgagtgtgatgtgagcctaagcctagtcagcagcatagaaccaaaggcctgcactagcgaacacacctatgctaaaacctaaaaccccatgtacatatgttctgttaatacggcctcctcgctgagtccacgtacttactacatttctacacttttaatacatcagtgtccgtgttaagtttattattcgtgacccatttgtgctgttctcggtatatgcaaatacattggacttcactgtttattcttgtacataagaagtgcaatatggagatgtatacagtctttgctatgttaggtttataaactgtttttaaaaagaaattcatccttttgccaaaatggtggagtatgtgattggtaaaccctaaaccctgtggtgagtggagggataatttaaagttttcaccatgttatattttcttttaagactttaatttagtaattttatatttgggaaaataaaggtttttaatttaactggaatcactgccctgctgtaattacatatcatgtaccccaactgtattaaaaataacactgctgattttctggtaaaaaacgaaaaaaa

SEQ ID NO: 2674 - DNA, 2217 bp, Rattus norvegicus
  Genbank Accession No. X70369
tgcccccggagagaaaggtgaaggaggccctcctggtgccgcaggaccccctggtggttctggacctgctggtcctcctgggcctcaaggtgtaaagggtgaacggggcagtcctggcggtcctggtgctgctggctttcccggtggccgtggtcttcctggtcctcccggcaacaatggtaatccagggcccccaggacccagtggtgctcctggcaaggatggccctccaggtcctgcaggtaacagtggttctcctggaaaccctggagtagctggaccaaaaggtgatgctggccaaccaggagagaaggggccacctggtgctcagggtcctccaggatctccaggtccacttggaattgcagggctaactggagcacgaggtcttgctggaccaccaggcatgccaggtccacggggtagccctggacctcagggtatcaagggtgaaagtggaaagccaggagccagtggccataatggggaacgtggtcctcctggaccccaaggtcttcctggtcagcctggtacagctggtgagcccggaagggatggaaaccctggatcagatggtcagccaggtcgagacggatctcctggtggcaagggtgatcgtggtgaaaatggttctcctggtgccccaggcgctcctggtcatccaggaccacctggtcctgttggtccatctggaaaaaatggtgacagaggagaaacgggtcctgctggtccttctggtgctccaggtcctgctggagctcggggtgctcctggtccccaaggtccacgaggtgacaaaggtgaaactggtgaacgtggctctaatggcatcaaaggacatcgaggattccctggcaatccaggtcccccaggttctcccggtgctgctggacaccagggtgcagttggtagtccaggccctgcaggtcccagaggcccagttggtccacatggacctcctggaaaagatggatcaagtggacatccaggtcccattggaccaccagggcctcgaggtaacagaggtgaaagaggatctgagggctcgcccggtcaccctggacagccaggaccccctggaccccctggtgcccctggtccctgctgtggtggcggtgctgccattgctggagttggaggtgaaaagtctggcggcttttcaccatattacggggatgatccaatggatttcaagatcaacactgaggagatcatgtcttcactcaagtctgttaacggacaaatagagagtcttatcagccctgatggttctagaaaaaaccctgctcggaattgcagagacctgaaattctgccaccctgaactcaagagtggagaatactgggttgatcctaaccaaggctgcaagatggatgctataaaagtgttctgtaatatggaaaccggagaaacatgcataaatgccagtcccatgactgtcccgcggaagcactggtggacagatgctggtgctgagaagaaacatgtttggtttggagaatctatgaatggtggctttcagttcagctatggcaatcctgatcttcctgaagatgtccttgatgtacagctggccttcctcagacttctttccagccgggcctcccagaacattacataccactgcaaaaacagcattgcctacatggatcaggccaatggcaatgtaaagaagtctctgaagctgatgggatccaatgagggagaattcaaggctgaaggaaatagcaaattcacttacacagttctagaggatggctgcactaaacacactggtgaatggagcaagacagtctttgaatatcaaacacgcaaggccatgagactccccatcatagatatcgcaccctatgacattggtggtcctgatcaagaatttggtgtggacattggccctgtttgctttttataagccaaactctctgaaaccccagcaaaacaaaaaccacatccatgtgttcctcttgctttaatctcgtcaaccagtgaaagtgaccaactaaattccagttatttatttccaaacttttggaaaaagcataatttgacaaaaatagaatacaatttttttgctgtttcacccaccaatacagttcaaatgcttttgttttatttttttaccaattccaacttcataatgtctcaatggtgctataataaataaacatcaacacttttatgataaaaaaaaaaaaaaaaaaaaaaaaaaaaaaaaaa

SEQ ID NO: 2675 - DNA, 1339 bp, Rattus norvegicus
  Genbank Accession No. X70667
cggctgtaactgtagcaaccggtgttgggtggggatgagaagagaccagagagagagagggtcagagcgacaggggatgagacaggctggtcagagtctgcactgattgttggagacgcaaaggaaagttttttctatgtctccaacctccccctcctcccccgtttctctctggagaaactaaaatctagactggacagcatccacaagagaagcacctagaagaagatttttttttcccagcagcttgctcaggaccctgcaggagctgcagccggaactggtcccgccgataaccatgaactcttcctgctgcccgtcctcctcttatccgacgctgcctaacctctcccagcaccctgcagccccctctgccagcaaccggagtggcagtgggttctgcgagcaggttttcatcaagccagaggtcttcctggcactgggcatcgtcagtctgatggaaaacatcctggtgatcctggctgtggtgaggaacggcaacctgcactcccccatgtacttcttcctgctgagcctgctgcaggccgacatgctggtgagcctgtccaactccctggagaccatcatgatcgtggttatcaacagcgactccctgaccttggaggaccaattcatccagcacatggacaacatcttcgactctatgatctgcatctccctggtggcctccatctgcaacctcctggccatcgccgtggacaggtacgtcaccatcttctatgccctccgttaccacagcatcatgacggttaggaaagccctctccttgatcgtggccatctgggtctgctgtggcatctgcggcgtgatgttcatcgtctactccgagagcaagatggtcatcgtgtgcctcatcaccatgttcttcgccatggtgctcctcatgggcaccctgtacatccacatgttcctcttcgccaggctgcacgtccagcgcatcgcggcactgccacctgctgacggggtagccccgcagcagcactcgtgcatgaagggggccgtcaccatcaccatcctgctgggggttttcatcttctgctgggcgcctttcttcctccacctggtcctcatcatcacctgccccaccaacccctactgcatctgctacacggcgcacttcaacacctacctggttctcatcatgtgcaactctgtcatcgaccccctcatctacgccttccgcagcctggagctgcggaacaccttcaaggagattctctgcggttgcaatggcatgaacgtgggctaggaacccccgaggaggtgttccacggctagccaagagagaaaagcaatgctcaggtgagacacagaaggg

SEQ ID NO: 2676 - DNA, 1448 bp, Rattus norvegicus
  Genbank Accession No. X73371
cctctagatgcatgctcgagcggccgccagtgtggtggaattctgccaaactcggagagaagcctgtgcctgcagctgactcactccaggactgatgggaaccctgctgttcctaccgctccccatggacagcaacaggactgtcgtccatgtgctctcacggactttgtaccatatgctactgtggacagctgtgctaaatcttgttgctgagtctcatgcaggtcttccgaaggctgtggtgaaacttgagcccccatggatccaggtgcttaaggaagacactgtgacactgatgtgcgaagggacccacaacaccaagaactgttctactcagtggtttcacaatgggagctccatctggcatcaagcccaagccaactacacgtttaaggccacagtcaatgatagtggagaataccggtgccgaatggaggagaccggcatcagcgaacccatacatctgggagtgatttctgactggctgctactccagacctctcaactggtgtttgaagaaggggaaaccatcacattaaggtgccatagctggaagaacaaacagctgactaaggtcttgttgttccagaatggaaaacctgtgaggtattatcatcaaagcagcaatttttcaatccccaaagccaaccacagtcacagtgggaactactattgcaaagcatatctaggaaggacaatgcacgtgtccaagcctgtcaccatcactgtccaagagcccaaatccagcagttcgttgccggtattgacgattgtagctgctgtcgctggaattgctgtagctgccattgttattatcctggtatccttggtctatctcaagaaaaagcaggttccagacactccttctggtctcgaagaagctgagaaaaatgaggtggagaatacaatcacctattcacttctcaagcatcctgaagctccggatgaagaatcagatcacgactaccagaaccacatttagtctctcttgagattgggaaaagcaaaccagtaaggccaggacctagcgtctcctggtccaaggaatgctgtagatatgaaagaaaacatctagagtcccttctgtgagtcctgaaaccaacagacactacgatattggttcccaatggttgactgtactaatgacttccataacttacagcttcccaactaaagactcttttgctatagatccacacagccaataaaattaatcaacttactgttgttaagagactacagcaacgtgggaactgcttatattacatgctaaggagaacaagtaacattaggatgcataatctcagcgaggatcaactagacgtgtaccaacctgtcaaaagtgatgcttctttataagaaactttatttccttatttttctataaaggtcacatattacttttatagtaaaatgttgtgaaaatgtccaaaaaaaaaaaaaaaaaa

SEQ ID NO: 2677 - DNA, 1454 bp, Rattus norvegicus
  Genbank Accession No. X75207
ccgtcgacggccattaccaatcgcgaaaccggcgcagtagcagagagctgcagactccgcgcgctccggagaccggtcgtagagcgcgaggcagcgtcagcagcagacaccggagcccaacccggaccacagccctccccaggcggccgcgcatggaacaccagctcctgtgctgcgaagtggagaccatccgccgcgcgtaccctgacaccaatctcctcaacgaccgggtgctgcgagccatgcttaagactgaggagacctgcgcgccctccgtttcttacttcaagtgcgtgcagagggagattgtgccatccatgcggaaaatcgtggccacctggatgctagaggtctgcgaggagcagaagtgcgaagaggaggtcttcccgctggccatgaactacctggaccggttcttgtctctggagcccctgaagaagagccgcctgcagcttctgggggccacctgcatgttcgtggcctctaagatgaaggagaccattcccctgactgccgagaagttgtgcatctacactgacaactctatccgccccgaggagttgctgcaaatggaactgcttctggtgaacaagctcaaatggaacctggccgccatgactccccacgatttcatcgaacacttcctctccaaaatgccagaggcggatgagaacaagcagatcatccgcaaacatgcacagacctttgtggccctctgtgccacagatgtgaagttcatttccaacccaccctccatggtggctgctgggagtgtggtggccgcgatgcagggcctgaacctgggcagccccaacaacttcctctcctgctaccgcacaacgcactttctttccagagtcatcaagtgtgacccggactgcctccgtgcctgccaggaacagattgaagcccttctggagtcaagcctgcgccaggcccagcagaacatcgatcccaaggccaccgaggaggaaggggaagtggaggaagaagctggtctggcttgcacacccaccgacgtccgagatgtggacatctgagggccaccggcaggcgggagtcaccaagtagtggcatcgcgaagagaaaggagccagcccgggtgctcctgacgaggtccccttgggatgtgttgttaccagaaggggaagttttgttctctttgttggttgtttttccttaatctttctcctttctatctgatttaagcaaaagagaaaaaaaatacctgaaagctgtcttaaagagagagagagagatagaattcgcatcaccctgagtatagggagacgggggggtgctacaaaaatagaattctgtaccccagtaatcaactagttttctattaatgtgcttgtctgttctaagaataggattaacacacaggaagtcttgagaaggatttttgattcttttatgtgtttaagaaaaaaaagcttaagaaacattgcttt

SEQ ID NO: 2678 - DNA, 3551 bp, Rattus norvegicus
  Genbank Accession No. X76456
gtgtcctctgtctctgtctctgtctctgtctctgtctctgtctctgtctctgtctctgtctctgtctctgtctctctctctctctctctctgtgtgtgtgtgtgtgtgtgtgtgtgtgtgccttagagtctcttagactggctggcctgagagtcacagggaactacctagctacacttctcagtactgggatgagaggtgtgcattagaatgcctgcgttttacacgagctctggagactaaactcaaatcttcctacttgccaggcaagcagttaatgtcattatactgcatttccattttgatgtgttagctagtcatttctcttttaacatttggagtattttataactttggaggtagggctattcttaccctgtgaactgcttttcctctctctctctctctctctctctctctctctctctctctctctctctctctctctctcaagtcaagagattcccccctccgcatcattttcccctagttaataattaccaagaaatttgcaccaagaccaaaaaaagcctatgtatttcagaaatagattaactaggttactttttaacaaagcttaggtcaaagaatactataaaacgttggttttgccccagtcgcattactctcttgaatgtggcctcttttttaaatttaaacatgagacacttaaaacttacaggttttatttttttcctgttgtctttgactgaatccctagccctacccacaaagcctcaggatgtaggtaagaaatttacttgtgtattaccagggacaactaagtgaaggaaattactttcctttagccttttaaaactttgattattccggtggttttatttttctctctcttctcttagtatatgtatactggtcagtagtttcaaaggacccactacagattttcatattatctattctgtaggatgcttgcctttagaaacggccaacaatctggatcatgttgacttgagatgtaatttggacttcaaaaatattagaattttgtgacagatatagatatataaatatatgtatagtccaacagaagagcatagatacagtatatacatattcatacatatacatacatacacacatatgtacacactcacacacaaacacatgtataaacatttatatacaatctttaaaaaatattttttaaatatttttggttgtccaatatgtcttccagctagatgataaataccgtcaggtatatgagatcctgctttctccttcagctggcgttacacacctgcaacatactacgccaagagcaaggcgtgtcaaccgggtggaaaaggcaatttttacattttaccaaatgaggaaactttgaaattttctttgaaagaaaagaaaattttctttgaaaggtctttttaaatacctctggccagaaaggcacattttttttttacaggaatgtagtttccttaatatcatcccagagaacatatactcaagtgatattatacagactgataaggttgtatctatgtatcagagaatgtaaaaatttataatatatataacatcaatcaatcaattaatgaaaaagaggccatgcatttgaaagagagcaaggaggggttaacaggagaacaggcaggggatcatttcaatgctactcagaaattcataaatgagaacgttgcatacctgaccatcattgcatctgcccagtatgttcaggaagcatcctttgaggaggtggaaatgctggtgaaggtcatgctggattacaaggataggtgcttggctgacagcacacttccggagtgttcaaagatagctaatgatgctatccaggacatgctctgtgatatgaaggggctgccacagaagcataacttctcccattgctgtaggcaagccggctttcaaagaagactctgcttcttctacaacaagaaagctaatgtaggatttctgccccctttccctactctggatccagaagagaaatgccaagcttataaaaataacagtgaatcttttctcaacctctatatgtatgaggtggccagaaggaacccctttgccttcgccccagttcttctgaacgttgccgctaggtttgaggaggcggcgaccacgtgctgtgaacagcaacagaaagccacctactttcaagacaaggcagcccccatcacacagtatttaaaagcgttatcttcttatcaaagaaatgtttgtggagcccttttaaaatttggacccaagaccttaaactctataaacatcgccgtgtttagtaagaagttccccaagattggatttgaagaccttacgtccctcttagaagatgtttcttccatgtatgacgggtgctgtgaaggggacgtcgtgcagtgcatccggagccagagccaggttatgcaccatatttgttcaaaacaagactccatctcaagtaagatcaaagcgtgctgtgagaagaaactgccagagcgcgcagactgcataatcaacgcaaacaaggatgacagaccagaagacttatctctgagaacacccaaatttaccgacagtgaaaatgtgtgccaagagcgagattccgagcaggacaagttctttgctgagtttctttatgattactccagaagacatactgaactgtctacaccagagctcctaagaattactaaagtgtataaggatctcctggaagattgctgcaacagaaaaaacccgttaagctgttaccgccatgcggaggataagttcaacgagacaacagagcgaagccttgcgatggtccagcaagagtgcaaacagttccaggaattggggaaggacgctctacaacgccatttccttgtcaagttcaccaaggcagcccctcaactccccatggaagaactggtctcccttagtaaggaaatggtggcggctttggcaacctgctgcactctcagtgacgagttcgcctgtgtggacaacttggcagatttagttcttggagaattatgtggaatgaataagaatcgaactatcaatcccactgtggatcactgctgcagagctgactttgccttcaggagaccctgctttgagcacctgaaagccgacaccacctatgcactcccatcagtctctgcacttgtatctgctttgcgtgcagactggtgtcagcctctcaaggaggaccttcagaataagagacacaggtttctggtcaacttagtgaagtggatgccagagatcacagatgaggaacgtctgtgtttgttcacaaagttcacggctgctggggaggagtgtggcaacatacagaagcctgaggcctgtttcagtccagagagttcaaaaaccggtgatgtgagtcaagatgcagagaaacaaaggtgaacggaatgaccagagccagtaccagctcacaggatcgtcctgtggagaagttcagctcttaagaagactggaatagaaggtccttctgtaaccctttcttgaatcatgttcctacaaaaggcaataaaaagggaggataaagtttctcgcggcgcgaaaaaaaaaaaaaaaaaaaaaaaaaaaaaaaa

SEQ ID NO: 2679 - DNA, 678 bp, Rattus norvegicus
  Genbank Accession No. X76489
atgccggtcaaaggaggtagcaagtgcatcaaatacctgctctttggatttaacttcatcttctggctcgccggcatcgcagtgcttgccattggactatggctgcggttcgactctcagaccaagagcatcttcgagcaagaaactaatcattccagcttctacacaggagtgtacattctgattggagctggggccctcatgatgctagttggtttcctgggctgctgtggagctgtacaagagtcacagtgcatgctgggattgttcttcggattcctcttggtgatattcgccattgagatcgccgcagccgtctggggctatacccacaaggacgaggtgattaaagaactccaggagttttacaaggacacctaccaaaagttaaggaacaaggatgagccccagcgggaaacactcaaagccatccatatggcgttgaactgctgtggcatagctggtggtgtggagcagtttatctcggacatctgccccaaaaagcaggttctggaatccttccaggttaagtcctgcccggatgccatcgatgaggtcttccacagcaagttccacatcattggagcagtgggcatcggtatcgccgtggtgatgatcttcggtatgattttcagcatgattctgtgctgcgccatccgcaggagccgagaaatggtc

SEQ ID NO: 2680 - DNA, 922 bp, Rattus norvegicus
  Genbank Accession No. X77117
ggcacttgagcctgctgtccatctggaaaacgttgcatgcttggcccgctgctctggactgcctctctgcctgttgtgagttccagccagccctgatagacccattccttttgtagagtatataaggtctgccccagtagctcctagtgactctgggcctggttggtggcttagattcccacagaaggtgctcaattatccacctgttcctcctcctgggtcccttcccccattgtctggagcccagcccagagcccccctgtttcaggatttcctccatcatcctcccacttcctcccacttagaacaagtcaggagggctgtggtcacttgatcctggcaggcagcaggagagtgggtggtcggcaggtagggagcctatgctggcttgcttagcccaggtcggacttggcaaccggaggaggcgggactgaactctctaccaaccttctctatccagcctgggcagaatggattccaggctttagagggggggaatgccacagtgagaagcccaggcaggatgtcccgtgggtgaggaacaggctgtgcatcccttagctatagtgagtgagctgggggctccctcctgggaccctggaacccagtttctttacctccctttgctgtcagagcaaggagaagaagaggtaggttccttggaatgtggcctgcaaggtcaaggtctgggaggcagctgcctttaaggacttaaaactgagaggggtgtgtgtgtgtgtgtgtgtgtgtgtgtgtgtgtgtgtgtgtacagctgaggagaagctggggcagggacttggccttggccatctgcctcctgtttacttgccctttgctgctgggactagggtggtgccatggaaggatgggggacagcctgtttaccccatgccagtaaggatagaatatatccagtcccctg

SEQ ID NO: 2681 - DNA, 1374 bp, Rattus norvegicus
  Genbank Accession No. X80130
aggcctgccaccagcgccagcccagctgaacccagccgcccaaagcacgcctacagatcccacagaagctgtaccaggatgtgtgacgacgaggagaccacagctttggtgtgcgacaatggctccggactggtgaaggctggctttgcgggtgatgatgctcccagagctgtcttcccatccatcgtgggtcgcccacgccaccagggtgtcatggtaggtatggggcagaaagactcctatgtaggtgacgaggctcagagcaagcgaggcatcctgactctgaagtaccccatagagcacggcattatcaccaactgggacgacatggagaagatctggcaccacaccttctacaatgagctccgtgtggcccctgaggagcacccgaccctgctcactgaggccccactgaaccccaaggccaaccgtgagaagatgacacagatcatgtttgagaccttcaatgtgcctgccatgtatgtggccatccaggcggtgctgtccctgtacgcttctgggagaaccacaggcattgttctggattctggcgacggtgtgactcataacgtccccatctatgagggttatgccttaccccatgccatcatgcgtctggatctagctggtcgggacctcactgactaccttatgaagatcctcactgagcgcgggtactcctttgtcaccaccgctgaacgtgaaattgtccgagacatcaaagaaaaactgtgttatgtcgccctggattttgagaatgagatggccaccgctgcatcttcctcctctctggagaagagctacgaacttcccgatggccaggtcatcaccattggcaacgagcgtttccgctgtcctgagactctcttccagccctctttcattggtatggagtctgccggcattcacgaaactacttataacagcatcatgaagtgtgacatcgatatccgcaaagacctgtacgccaacaatgtcctgtctggaggcaccaccatgtaccctgggattgctgatcgtatgcaaaaggaaataactgcactggctcccagcaccatgaagattaagattattgctccccctgagcgtaaatactctgtctggattgggggctccatcctggcctctctgtctaccttccaacaaatgtggatcagcaagcaagagtacgatgaggccgggccctccattgtccaccgcaagtgcttctgaggcggctaccttacactcaggacgacagtattgtgcttggaatcctctgaggccctctcccatctcccatcagtcattgtacagtttgtttacacacgtgcagtttgtttgtgcttcaaatatttattgctttataaataaaccagaccaggacttgcaacc

SEQ ID NO: 2682 - DNA, 3949 bp, Rattus norvegicus
  Genbank Accession No. X82669
agtttcacttctgctcctaacctgtgtcaggtccttctgcccggacactgacgacactatggccattctcactcccattgggtgctgtgaaccctgtgaaccaatcagcgtcgtcatggtacaggagttataaagtccgcgcagcccgcgggactcagactcgtccggattctcacatgggggcgatggcaccgcgcacgctgctcctgctgctggcggccgccctggcccagacccagacccgcgcgggtgagtgcggggtcgggagggaaacggcctctgcggggaggcgcgggggcggttttggggaagccgggtccccgcgtcgcacaccagacctccgccccttctccacccgcgtcccgagccccgcgccctgctccccgcccggcccgcgctcccgcccgggttcccgggaggaggtcggggtctcaccgcgcgccgcccccaggctcacactcgctgcggtatttcctcaccgccgtgtcccggcccggcctcggggagccccggttcatcgctgtcggctacgtggacgacacggagttcgtgcgctacgacagcgatgcagagaatccgaggatggagccgcgggcgcggtggatggagcgggaggggccggagtattgggagcgggagacgcagggagccaagggacacgagcaggtgaaccgagtgaacctgaggaccctgcgcggctactacaaccagagcgagggcggtgagtgaccccgggtcggaggtcacgacccctccgcgtccccacacggccggggacttccgggtcccaagtccgaggttcgggagcagaaccgacccgggcccggtttccctttcagtttggaggagtccgcgggcggggcggggctggggcggggtctgaccgcggggtcctgcaggctctcacaccatccaggtgatgtttggctgtgacgtggggacggactggagcctcctccgcggatataggcaggacgcctacgacggccgcgattacatcgccctgaacgaagacctgaagacgtggacggcggcggactttgctgcacagatcacccggaacaagttggagcgggatggtgatgcagattattacaaggcctacctggagggcacgtgcttggagtcgctccgcagatacctggagctcgggaaggagaggctgctgcgctcaggtacgtggaccgcgggcttctcctcctctgcccttaggctggggctcagtcctggggaagaagaaaccctcagctgggtgatgcccctgtctcagaggggagacagcgtccctgggtctcctgatccctcatcacagtgactgcactgcctctcccagggcccagccttctccctggagagttctgagtccctctcaggagggcaaggagagaatttcccacttaacagcaagggctccctgctgtcagccatggcctctcccaggccaggttctctgctccgactctctgaggacactgactcctgtcctgctgagtgtgtcagcgttacacctcaggaccagaagtctcctttacctcatgggagacatggactccactacactaggctggttccccagtttctagaactttccaaagaacacattctcacagatccctccctgatgtggggtttgcctctcttccacaccccaattctctctcttcctacagtggagaatggtcccatgagcccttgtggggtaccctgaaggaacataaattgtgggatttcttttttcttttttctctctttttcttatcttttactttcttttttctttccttttctttccctttttttttttgaaggattattttgcttccagtcaagatttctctgcaaacacatattaaatcaattattttccattccctctttattctgtgaccacccatctcatgctataaaacatcacataaggacggccatgttgacccactcgaatcatgtggatttcctcttagcttctgagtccctcaggaaagtgtgcagttctgtgctgagggcaccagctctccctgcagctcactagtgagatgacagttgaagtgtcagacacacacagttcagtgtcatcattgatttaactgtgtcttgtgtagatttcagtttgtcttgttaactgtgtgatttcttaaatcttccacacagatcccccagaggcacatgtgacccttcaccccagacctgaaggtgatgtcaccctgaggtgctgggccctgggcttctaccctgctgacatcaccctgacctggcagttgaatggggaggacctgacccaggacatggagcttgtggagaccaggcctgcaggggatggaaccttccagaagtgggcatctgtggtggtgcctcttgggaaggagcagaattacacatgccttgtggagcatgaggggctgcctgagccactttcccagagatggggtaaggagggagccttctgtagaccctgagctggtcagggctgagagctggggtcatgacccccaccttcatttcttgaacctgtccttcccagagccttctccatcgaccaactccaacatggaaaccaatgtcatttatgtcgcccttggagccatcattggaactctggccatcattggaattgtggtggctgttgtgaggaagaggaggagaaacacaggtaggaaaggacagggtctgtttcccctcagcttcctttagaagagtgctgctcattaatgggaagcacagccacaccccctattgctgctgctccaactgggtcctctgtcagttctggaaacttcctcctgtcaagaccttccttgaactctcacagcttttcttctcacaggtgggaaaggagactacgcccctgctccaggttagtgtgggcgcaggagtgtccctgagggtattggagtgaagctggagatgtggggagctctgggaatccatagtagctcctccaaatcttctggggctgcagttgtactgtgcgtgatatgaatacatacatacgcatatacatatacacacacacatatacatgtgttttgttttaccctaggcagggacagctcccagagctctgatgtgtctctcccagattgtaaaggtgactctggggtttgactgggaagggacaatgtggacatgattgggttcatggactcccagaatcctctgtttcatggactcccagaatcctctgggagtgttgtcttcacagtgatggtttgtgactctcgttctgtagcatgaagacagctgcctggagtggactgagtgacagacgatgtgttcaggtctctcctgtgacatccagagtcctcagttctctttagacaccagtgtctcatgttccctgtgattctatggcttcagtgtgaagaactgtggagcccagcctgccctgcacacctggaccctgtccctgcacctgccctgcattcctttccacctgccaaccttgctggtccagcctggggtaggggtaatgggacacgcacctgtcactccttgctgccctgagccttcagcccctcactccacactgagaataagactctgagtgtgaacttgattgttcacatccttgacccaagtgtggatggctttttaattactggattgagaatacttagaggttttttgttttggggttttgctttgttttgttttgtttttgaaaaaaataaatggcagatgaagaagcttccagaatctgtgtcactaagctgtgtgtgtctggtgggacagggtgaggtggtgggagctgagtgtggacagggctgtgcccaggtgtgctcagtcagttcttgtctttgatgggttcaggcctcagctctgtcacctccaggctgtgccctctccatcactgtgaacacatggggagagtctgtgatcgcgatgacacagggaaggccagagccttgtcctgtccccaggattatgagcccccgcggctgaagatcac

SEQ ID NO: 2683 - DNA, 463 bp, Rattus norvegicus
  Genbank Accession No. X89694
catctcccggcccctccactatgtctccatcatgaacacccggctgtgtgtgggactggtggtggctgcctgggtaggaggttttgcccattccattgtccagctgtgtctgatgctcccattgcccttctgtggccccaacatcctggataacttctactgtgatgtcccccaagtgctgagacttgcctgcactgacacctccctcctggagctcctcatgatctccaacagtgggatgctggtcctcatctggttcttcctccttctgatctcttacactgtcatcctggtgatgctgaggtcgcactcagggcaggcgaggaggaaggtggcgtccacctgcaccacccacatcatcgtggtgtctatgatcttcattccctgcatctacatctactccaggcccttcagtccctttcccttggacaaagccgtgtccatcagctacacagtcttgacc

SEQ ID NO: 2684 - DNA, 466 bp, Rattus norvegicus
  Genbank Accession No. X89702
aatatgctacccacttcgctactcaataattatgagccacagagtatgtgccatcctggccacagggacatcattttttggctgcattcaggccacttttctaactactctcaccttccagttgccctactgtggtccaatgaggtgggactactacttctgtgatatccctgtgatgctaaagctggcttgtgaagacacatcagccctggagatggtggggttcatcagtgtgggcctgatgcccctcagttgtttcctcctcatcctcacctcctacagctgcatcgtctgctctattctgcagatccgctctgctgagggccgtcgtagagccttctccacctgcagtgcccacctcactgccatcttgcttttctacatgcctgttgtcctcatatacttaaggccaactcctagcccttggctggatgcaactgtgcaggttttaaataatttggttact

SEQ ID NO: 2685 - DNA, 472 bp, Rattus norvegicus
  Genbank Accession No. X89706
agtttgtcggcccctgcactacatgaccgtcatgaatcctcggctctgctgggtgctggctgctattagctggttgggtggcttaggcaactccgtgattcagtcaacattcactctgcagctcccgttttgcggacaccggaaggtggacaacttcctgtgtgaggtacccgccatgattaaattggcctgtggggacacgagtctcaatgaggctgtgctcaatggtgtttgtaccttcttcactgcggtcccgctaagcatcatcctggtctcttactgcttcattgctcaggccgtgatgaagatccgctctgtggagggacggcggaaggccttcaatacatgcgtctcccacttggtggtagtgtttctcttctatggctctgctatctatgggtatctgcttccagctaagagcagtaatcaggaccagggaaaattcatttctctcttctactctgtggtcacg

SEQ ID NO: 2686 - DNA, 2492 bp, Rattus norvegicus
  Genbank Accession No. X94551
ccgggcaggtgacaaagccgtggagatctatgccagtgtggcccagctgacccctgtggactcggaggctctagagagtgaagcaaataaaatcaagaaagaagctgcagatctggaccgtctgattgaccagaagctaaaagattacgaggaccttagggaagacatgcgaggaaaggaacatgaagtaaagaaccttctagagaaggggaaagccgaacagcagaccgctgaccaactcctagctcgagccgacgctgccaaggctcttgctgaagaagctgctaaaaagggacgcaataccttacaagaagctaacgacattctcaacaacctgaaagattttgatagacgagtgaacgataacaagacagctgctggaagaagctctaagcgaattcccgccatcaaccggaccatagctgaagccaatgagaagacaagggaggcacagctggcgctgggcaatgcagcagctgacgccacggaggccaagaacaaagcccacgaggcggagaggattgccagtggcgtgcagaagaatgccaccagtaccaaggcggatgcggagagaaccttctcggaagagacagacctggataacgaggtgaatggcatgttgaggcagctagaggaagcggagaatgagctgaagaggaagcaagatgatgccgaccaggacatgatgatggcgggaatggcttcacaggctgctcaggaagctgaacttaatgccagaaaagccaaaaactctgtcagcagcctcctcagccaactgaccgacctcttggagcagctgggacagctggacaccgtggacctgaacaagctcaacgagatcgaaggctctctgaacaaagccaaagacgaaatgaaggtgagcgacctggacaggaaggtgtccaacctggagaacgaggcccggaagcaggaggcagccatcttggactatgaccgagacatagcagagatcataaaggacattcacaacctggaggacatcaagaagacactaccaacaggctgctttaacaccccgtccatcgagaaaccctagtggtgggagggctgtaaggcagtgtccctgacagggggccctgtgaggcctcggtgccttgacagcgaaaaaattacacttttcagaccccccccacttctctgctgctctctgtcactgtccttttgacccaagaaaagtcagagtttaaagagaagcaagttaaacatccttaaccaggaacaaagggttttgcctaataaagtgtctcctccacttctgtcagcaccctaccggaactttcccttgtttgcctgaagtcatagcatcttccagtggcatacccacatcacgtgagcctttgtatgccagggcagacccagccccctcccctctctcaagcaccatcagaacctatcttagtactccatttttctatgaaggagatgttcagctcctcacgtatgcactgagatggccaatatgtccagtcgcatcttctgcctcctcttgaagcaaaggaaataaacatcctgtgccaaaggtattggtcattagacgttggtagccatccatcagacatgctggctgtttgagcataggccactgagccattacgggtaacagtgtagttacgtgtgggtctctgagagagcatggctcaaagatgcttacatttttctcctgtgctaattgactaggaagataaacgtttcccaatcctcagccgcctgatagagagtctggatgggcagcttgcacataccactacactaggtagcttttgatagttttataagcaggactcagtgcagaagaaacagagatgtgataaccactcacgttttttttcccccaaatcttactaattcttggagcttcgttagtgtgttagaattggaacttattgttagcatatctatcaaaacagtcgtcctctaaggtcttgaccaatgaaagaaaagcaaatctcctttccacccattttctgggaagtggatgtaaccggtatgattaggattccataagtgaatttctctttctctgttggagagagatgtgacatttggcccttagctccaagtctcttctgacatttacattctttcaaaacacatcattgttggccagatcctggtggcaaacgctgctctcagtgtttctcaaggccgtggaccccatctagttcctgcgctttgtcgtccgcccactctaagcctttcctctgtgtggggagggaagaaccatgcatggcgtttcctagtgggcttctcgacctctgatcctcagctctgtggttcccttaagaccacaccgggacagttccctgccacacgcccccttcctcctatctacctgcctctgagattcgtatttagcctttaacactatgcaattttgtactttgcgtagcggggggggaaagaaactattatctgacacactggtgctattaattatttgaaatttatatttttttgtgtgaatggatttt

SEQ ID NO: 2687 - DNA, 1758 bp, Rattus norvegicus
  Genbank Accession No. X96437
gaatagcgtctcgggagtgtccctgggtaatcgctgcatctcgttttgtgtgtgtgctctgtcgaaacgtctgtgatgtgtgtatggttttcacgtgaacggaggcaggcagagttgggtctgtgggttctagtgtgttcttaatctttttggaagtttgtgcagtgacttcccctctgggattgtttcctatgcataccttcaagtatgtgtgaatgtgttttctgtggtcccttgatcttactgggcttctctaaggagggtggctggaccatctgctacgtgtctgggagcccctctctagctaccacatgtcccgacatgtgcttactcccaatatttgcacccactcgcattcacaactcccaggcaaaaagaaaaaatcaaaaaaacaaaaaaaacgtgcactggggcacctagaaaatgggcagccaaggctccgcctacattttgcttcctccttggaatttccagccctgtgcagccaactgctccctagctgcgaagggcggagtttcccggctctataagtagtggtgccttaccggggatccgcactcctccgtaccctctgtacagcgcgcgaattatgtgccattcgcgtaaccacctccacaccatgactggcctgagggctccggcgccagttccctccaccggcccggaactccggcggggctccggtcccggaattttcaccttcgaccccctcccggagcgggcggtagcgtccgccgtgcgtccgaacacttctcgcgggcacggaaaacgcagccgacgggtgctctaccctcgagtggtgagtatcgcccgagtgggcagcaagaggtcgagtcgccccggaacctttgggaacaactagatgcggggactttcgtctgacgtttccctcttttctctgctcaggtccggcgccagctaccaaccgaggaacccaacattgccaagaggatcctctttctcctgctcgccatcatcttctgccagattttgatggctgaagaaggtgtgtcgcaggccctggctccggaggatgctaccagcgccatatcacctgagcccatctctgcgcccattactgcgcctcctgtcctcgagcctttgaacctgacctcggagtcctcggactatgctctggatctcaaagcttttctccagcaacacccggcggcattctaaacgcgatgggtcacagtccggaaaaaaaaacccaaagagcaccaggggtacctggtcggcaagaacgtatcccaaactgggacttataaggcaacgctaactcagaacactaccgccaagatgccggttcttggggcgagcccgaggcaccgtgggtcctggctaggctcactggtgacggacggaggtcttctccgtgtctaattaatatttatgtatttatgtatatcctcctaggtgaaggaggggtgtatgtaatatttattctaacttatgcaggggtgcgagatatgcccccttgctgtgacacagatatttattacgatttatagggtccgtgagacagagttgtgggaggattagtttagtcttggtcggggggcataggtttaggggtaacactccattttccagcacttcgactctgttgtaagactttggcagacccttgggaatacggtctgtgtgcctttgatgtcttcctgactggaagtcttgggtccatggattgtcagagggcggctgtctggggtcgcctagtatgttctgtgaacacgaataaacttgatttgcctgtcg

SEQ ID NO: 2688 - DNA, 1169 bp, Rattus norvegicus
  Genbank Accession No. Y00350
cgaacggcttgggactccagaatttcccggagctgaagaatgacacgttcttgagagcagcctggggagaggaaacagactatactcctgtttggtgcatgagacaagcaggccgctacttaccagagtttagggaaaccagggctgcccaggacttcttcagcacctgtcgatctcctgaggcttgctgtgaactgactctggagccagtgcggaggtttcctttggatgctgctataattttctctgacatccttgttgtaccccaggcattggctatggaggtgaccatggtacctggcaaaggacccagctttccagagccattaagagaagagcgggacttagagcgtctacgggatccagcagcagtggcttcagagttaggctatgtgttccaagccatcacccttacccgacaacagctggctggacgtgtgccactgattggctttgctggtgctccgtggaccctgatgacgtacatggttgaaggcggcagtttcaagaccatggctcaggccaagcgatggctctatcagaagccagtggccagtcacaagctgcttggcatactcactcatgctctggtcccatatctaataggacaagtagctgctggtgctcaggcattacagctctttgagtcccacgcaggacatcttggctccgagctcttcagcaagtttgcactgccttacatccgtgatgtggccaagcgagtgaaggctgggttgcagaaggcgggcctgaccaggatgcccatgatcatctttgccaaggatggacattttgccctggaagagctggcccaggctggctatgaggtagttggacttgactggacagtggctccaaagaaagcccgggaacctgttggaaagacagtgactctgcagggggaactggatccctgtgccctgtatgcatctgaggaagagattggtcgactggtgcagcagatgctgaatgactttgggccacagcgctacattgctaacctagggcatgggctttaccctgacatggacccagaacacgtaggagcctttttggatgcagtacacaaacactcacgcctgcttcgacagaattgagtatgtgcttttctgctcaagtaccaccgacacagattgtttccaggagaataaaacttccagaaacttcca

SEQ ID NO: 2689 - DNA, 1900 bp, Rattus norvegicus
  Genbank Accession No. Y07534
tgcctggatggggcgcgtagtctctggctctaaactcttggcttctcagacacgatctatggctgtgttgagccgcatgagactgagatgggcgcttctggacactcgtgtgatgggccatggcctctgcccacaaggggccagagccaaggccgcgatccctgcagccctccgggatcacgagagcacggagggtccaggaacaggtcaagaccgaccgcgcctgcggagtctggcggagcttccgggacccggaacgctacgctttttattccagctatttctacgaggctatgtgctgcacttgcacgagctccaggcgctgaacaaggccaagtacggcccaatgtggacaaccacctttgggactcgcaccaatgtgaatctggctagcgccccgctcttggagcaagtgatgagacaggagggcaagtaccccataagagacagcatggagcagtggaaggagcaccgagaccacaaaggcctctcctatgggatcttcatcacacaaggacagcagtggtaccatctgcgtcatagtttgaatcagcggatgctgaagcctgctgaggcagccctctacacagatgccttaaacgaggtcatcagtgactttattgcccggctggaccaggtgcggacagagagtgcatcaggggatcaggtgccagatgtggcacatcttctctaccaccttgccttggaagccatctgctatatcctgtttgagaaaagggttggctgcctggagccctccatccctgaggacaccgccaccttcatcagatctgttggactcatgttcaagaactcagtctatgtcactttccttcccaagtggtctcggcctctgctgcccttttggaagcgatacatgaataactgggataacattttctccttcggggagaagatgattcatcaaaaagtccaggagatagaagcccagctacaggcggctgggccagatggggtccaggtatctggctacctgcacttcctgctgactaaggaattgctcagtcctcaagagactgtcggcacctttcctgagctgatcttggctggggtagacacgacatccaatacactgacctgggccctgtatcacctttcaaagaacccagagatccaggaagccttgcacaaggaagtgactggtgtggtacccttcgggaaggtgccccagaacaaggactttgcccacatgcccctgctaaaagctgtgattaaggagaccctgcgcctctaccctgtggttcccacaaactcccggatcatcacagaaaaggaaactgaaattaatggcttcctcttccctaagaatacacagtttgtgttatgccactacgtggtgtcccgagatcccagtgtctttcctgagcccgagagcttccagcctcaccgatggctgaggaagagagaggacgataactccgggatccaacacccatttggctctgtgccctttggctatggggttcggtcctgcctgggtcgcaggattgcagaactggagatgcaactcctgctgtcaaggctgatacaaaagtatgaggtggtcctgtctcccgggatgggagaagtgaagtctgtgtcccgcatcgtcctggttcccagcaagaaggtgagcctacgctttctgcagagacagtagtaccaagctgggctcctgctccatgggacttgtccagaagccctggcacagaagttcttggccagtctcacgtcacatgtcacgatgccagattcaacaggggacctctctgcccttcccatagacaccagacgtctggcacaatctctactgagcagcacccatttaagacattagagcacctcatatcacaggacggtgcttgggtacaatttaaaataaaatttaaaattcaaaaaa

SEQ ID NO: 2690 - DNA, 1662 bp, Rattus norvegicus
  Genbank Accession No. Y08355
cattcagtttagtcagaatccatgggtgggctcagctgtctcctccgtacctagtctgcggttatggcttcgctcacggtgaaggcctatctactgggcaaggaggaggcggcccgcgagatccgccgcttcagcttctgcttcagcccggagccggaggcggaagccgcggctggcccggggccctgcgagaggctgctgagccgggtggctgtgctgttccccgcgctgcggcctggaggctttcaggcgcactaccgcgatgaggatggggacttggtcgccttctccagtgatgaggaactgacaatggccatgtcctatgtgaaagatgacatcttccgcatctacattaaagagaagaaggagtgccggcgggaacatcgccccccatgtgctcaggaggcacgaagcatggtgcaccccaacgtgatttgtgatggttgcaatgggcctgtggtgggaactcgctataagtgcagtgtgtgccccgactacgacctgtgcagcgtctgcgaggggaagggcctgcacagggagcacagcaagctcatctttcccaacccctttggccacctctctgatagcttctctcatagccgctggcttcggaagctgaaacatgggcactttggctggcctggctgggagatgggcccaccagggaactggagcccacgtcctcctcgcgcaggggatggtcgcccttgccccacagctgagtcggcttctgctccatcagaggatcccaatgtcaatttcctgaagaatgtgggggagagcgtggcagctgccctcagccctctaggcatcgaggttgacattgatgtggaacatggagggaagagaagccgcctgacacccacctctgcagaaagttccagcacaggcacagaagataagagtggtactcagccaagcagctgctcttcggaagtcagcaaacctgacggggccggggagggccctgctcagtctctgacagagcagatgaagaagatagccttggagtcggtgggacagccagaggaactgatggagtcggataactgctcaggaggggatgacgactggacgcatttgtcttctaaagaagtggacccatccacaggtgaactccagtctctacagatgccagaatcggaagggccaagctctctagacccctcacaggaaggccccacagggctgaaggaagctgccctgtacccacatctcccaccagaggctgatccccggctgattgagtcactctctcagatgctgtccatgggtttctcggatgaaggcggctggctcaccaggctcctacagaccaagaattatgacatcggggctgctctggacacgatccagtattcaaagcaccctccaccattgtgacagtgctgtggccaagtcccacaacccacctcccttgtcttctagttgcatcatgtagagtagcagggcttctaaggcccagtgtcttggcattcttctagaaccttcaggtgggactgtgaggccttcttaggcagtaggaaagtgcatgagaagagagtctgagtgtgcacatgctgacccctgagcacagatccaagcagctgtggctgggcttmcgctgctttccctcggcctggcctttgccagggagctgtggagtcatgctgcactccactt

SEQ ID NO: 2691 - DNA, 1311 bp, Rattus norvegicus
  Genbank Accession No. Z12298
cggttttttttttttttcaacctagtgacagtcacagagcagcaccaccccctcctcctttccacacctgcaaactctcttgcttgggctgcattacttagtgttaattacatcgcagctttgagggctccggtggcaaatacccggattaaaaggtggtgaaaacgcatgagacaaccatgaaggcaactctcgtcttattccttctggcgcaagtctcttgggctggaccatttgagcagagaggattatttgacttcatgctagaagatgaggcctctggcataatcccttacgaccctgacaatcccctgatatctatgtgcccctaccgatgccaatgccatctccgagtggtgcagtgttctgatctgggtctggacaaagtaccctgggagtttccacctgacacaacattgctagacctgcaaaacaacaaaataacagagatcaaagagggggcctttaagaacctgaaggacttgcataccttgatccttgtcaacaacaagatcagcaagatcagcccagaggcatttaaacctctagtgaagttggaaaggctttatctgtctaagaaccacctaaaggagctgcccgaaaaattgcccaaaacactccaggagcttcgactccacgacaatgagatcaccaaactgaagaaatctgtgttcaatggactgaaccgtatgattgtcatagaactgggcggcaacccactgaaaaactctgggattgaaaatggagccttgcagggaatgaagggtctcggatacatccgcatctcagacaccaacataactgctattcctcaaggtctgcccacttctatcagtgaactgcatctggatggcaacaagatcgccaaagttgatgcagccagcctgaaaggaatgtctaatttgtctaagctgggtttgagcttcaatagcatcaccgttgtggaaaatggcagtctggctaatgttcctcatctgagggagctccacttggacaacaacaaactcctcagagtgcctgctgggctggcacagcataaatatgtccaggtcgtctaccttcataacaacaacatctccgaagttgggcagcatgacttctgcctcccttcataccagactaggaagacttcctacactgccgtgagtctttatagcaaccctgtccggtattggcaaattcacccacacaccttcagatgtgtcttcgggcgctctaccattcaacttgggaactacaagtaactcccaaacagcctcatttttataatcgggaacaaaaaaaccaatctgtcaatattattgctaaaaa

SEQ ID NO: 2692 - DNA, 822 bp, Rattus norvegicus
  Genbank Accession No. Z21935
ggctgtggaggcaatggcctggtgctgtcggctacggacagcagggcttgccggaaggtagccgtgaagaagattgtgctgagtgacgcacgaagcatgaagcacgcgctccgagagatcaaaatcatccggcgcctggaccacgacaacatcgtcaaagtgtacgaggtactgggacccaagggtagcgatctgcagggcgagctctttaagttcagcgtggcttatattgtccaagagtacatggagactgacctggcatgcctgctagagcagggcacgctgaccgaggagcacgctaagctattcatgtaccagctgctgcgtgggctcaagtacatccactctgccaacgtgttgcacagggacctgaagcccgccaacattttcatcagcacggaggacctcgtgctgaagatcggggatttcgggctggccagaatcgcggaccagcattactcccacaagggttatctgtcggaagggttggtgacaaagtggtaccgctctccacgactgctcctgtccccgaacaactacacgaaagccatcgatatgtgggcagctggctgcatcctagcggagatgctcacggggaaaatgctctttgctggggctcacgagcttgagcagatgcagctcatcctagacaccatccctgtagtgcgggaggaagacaaggaggagctgctcagggtgatgccgtcctttgtcagcagcacttgggaggtgaagaggccactgcgtaagctactcccggatgtcaaccgtgaagccattgactttctggagaagatcctgacgttcagccccatggaccgg

SEQ ID NO: 2693 - DNA, 2407 bp, Rattus norvegicus
  Genbank Accession No. Z48444
ggtcctgagctcctgaggaaaaagcgcacaactctgcctgagagaaatacttgtcagctctatatccagacagatcacctgttctttaaatcctatggaacacgagaagctgtgattgctcagatatccagtcatgttaaagcaattgatgcaatttaccagactacagacttctccggaatccgtaacatcagctttatggtgaaacgcataagaatcaatacaacatctgatgaaaaagatcctacaaatcctttcaggttcccaaatattggtgtggagaagttcctggagttgaattctgagcagaatcatgatgactactgcttggcctatgtcttcacggaccgggattttgatgatggtgttcttggtctggcatgggttggagcaccttcaggaagctctggaggaatatgtgagaaatccaagttgtattcagatggcaagaagaagtcattgaacacgggcatcattactgttcagaactatggctctcacgtgcctcccaaagtctctcatattacttttgctcatgaagttggacataactttggatctccacatgattctggaacagagtgcactccaggagagtctaagaacttaggccaaaaagaaaatggcaattacatcatgtatgcgagagcaacgtctggggacaaacttaacaacaacaaattttcactctgcagcattaggaacataagccaagtgcttgagaagaagaggaacaactgttttgttgaatctggccagcctatctgtggaaatgggatggtggagcaaggggaagagtgtgactgtggctacagtgaccaatgcaaagatgagtgctgcttcgatgcaaaccagccagaggggaagaaatgcaagctgaagcctgggaagcagtgcagtccaagtcaaggaccctgctgtacagcacagtgtgcattcaagtcaaagtctgagaaatgtcgggatgattctgactgtgcaaaggaagggatttgcaatggcttcacagccctttgcccagcatctgatcccaagcccaactttacagactgtaacaggcatacacaagtgtgcattaatgggcaatgtgcaggttctatctgtgagaagtatgacttggaggagtgcacctgtgccagctctgatggcaaagatgataaggaattatgtcatgtttgctgcatgaagaaaatggccccatcaacttgtgccagtacaggctctttgcagtggaacaagcagttcactggtcggactatcactctgcagccaggctctccatgtaatgacttcagaggctactgtgatgttttcatgcggtgcagattagtagatgctgatggccctctagctaggctgaaaaaagcaatttttagtccacaactctatgaaaacattgctgagtggattgtggctcactggtgggcagtactgcttatgggaattgccctgatcatgctaatggctggatttatcaagatttgcagtgttcacactccaagtagtaatccaaagttgcctcctcctaaaccacttccaggcactttaaagaggaggagaccgccacagcccattcagcagccccagcgtcagaggccccgggagagttatcaaatgggacacatgcgacgctgatgcagcttttgccttggttcttcctagtgcctacagtgggaaaacttcactccaaagagaaacctgttaagtcatcatctgcaaatgaaaccctcacagttaatagttgaagaaaaaatggcaagagatcatgtcctcagaccaggtggaattacctaaaatttaaagcctgaaaattccaatttttttgggggggtgggatggaaaaggaacccaattttcttatggacagatatttttaacctaatggcacaaagtcttagaatattattatgtgccctgtgttccctgttcttcgttgctgcattttcttcacttgcagacagacttggctctcgataaacttttatcacaaattgaaatatatttttttcaactgccaatctaggctgggaggctcgaccacctcaacattggatacatcacttgccaatgtacataccttgtaatatgcagacatgtatttcttacgtacactgtacttctctgtgcaatttgtaaacagaaattgcaatatggatgtttctttgtataataaatttttccgctcttaatgaaaaattactgtttaattgacatactcaggataacagagaatggtggtgtgcagtggtccaggattctgtaatgcttcatgcaggccattttgaaatgagaattgaaaaccctttttcttatggtggagttggttcttacatgcatccttttcctgttccatggcttctgtgagtaggagaggctgtgttgaagagctcagctggtggcttacccg

SEQ ID NO: 2694 - DNA, 1067 bp, Rattus norvegicus
  Genbank Accession No. Z49761
cgactcgctgagggtgttaaggtatggagcatgagcagaagtcaggagggctgctgaggctgctgcggcttctgtggctgctgcctcactcctgggcggtgcttgaagcttctccccaggcgtggtgggatgagtcgcagaaccacacattccgtcacactctgttctgccaggatgggtttcccaacatagggctctccgagacctacgacgaggacgcactcttctccttcgacttctcccagaacaccagagtgccccggctgcctgagtttgctgagtgggctcaggaacagggagatgcctctgccattgcgtttgacaaaggcttctgcgacatgttgatgcagaatgtgagcccgcggcttgaaggtcaaatcccagtgtccagaggtttgccttcggctgaggtgttcaccctgaagcccctggagtttggcaagcccaacacgctggtctgtttcatcagcaacctctttccaccgactttgacggtgacctggcagcatcatttcgtccccgtggagggagccagccccacgtccgtgtcagccatcgatgggctcaccttccaggccttctcttatttaaacttcacaccggagcccttcgacctttactcctgcactgtgacgcacgagattgaccgctacacggcaattgcctattgggtaccccagaacgccctgccttcagatctcctggagaatgtactgtgcggtgtggccttcggcctcggtgtgctgggcctcgtcgtgggcattgtcttcttcatccgctcccagagaccttgctcaggggactgattcttcccaaggagggcttggaacagcaccagccaggccggcagcgatgtccaggcatctcgcgcttaccagggtctttcctcagagccgaagtccccgggatcccttggggtgcatgccggcatgctaaggggttccgctgtccctggacttacatccagaaaagccggagtcaggagccccgggccccaccagaccactaccttataccttccctcatccaggaaataaagtttatttcttaaaaaaaaaaaaaaaaaa

SEQ ID NO: 2695 - DNA, 707 bp, Rattus norvegicus
  Genbank Accession No. Z75029
gctctgggtcggggcccaccatcgaggaggtggattagaggctctttctggcgctccaggtgtgatctaggagacagatgggtggccttgaggactttgggttattgtcgtttaggacattaactccttcgttcggtctgcaatcaagtcctaggtttaagcaaactgccttccatttactctgtggaatttcacgtgtgctttgcattcccagtaaattagtactgggagtgtgtctttgcaatagatataatttcctgccttcaagtcagcactgccccccccccgaagttatttctttgcaggacagtcagagctatattgatatagcaagaggtgtgttacaaaaacaccaggacactgttgagttcctttgtgtttggactctcccctgggcgacagtgttgaggcactgttaagtcaggagctcggggccaccggtggatcactgaaagctgagactctgttgcttctcccgtttgacactctgttgctttccttgcatggtggctcacctaaggctgagactcttgttctccttccctgtataatcttgcctggcgttgcacttgttccccagtgtgtgaactcggagatgagtttacaccaccactgttagttcacgttttttgtttttacataaccatcctgaactcaggtcaatttttagctggctatttgaaaataaacttcaaaagaacttgcca

SEQ ID NO: 2696 - DNA, 5721 bp, Rattus norvegicus
  Genbank Accession No. Z78279
atgttcagctttgtggacctccggctcctgctcctcttaggggccactgccctcctgacgcatggccaagaagacatccctgaagtcagctgcatacacaatggcctaagggtccctaatggtgagacgtggaaacctgatgtatgcttgatctgtatctgccacaatggcacggctgtgtgcgatggcgtgctatgcaaagaagacttggactgtcccaacccccaaaaacgggagggcgagtgctgtcctttctgcccagaagaatatgtatcaccagacgcagaagtcataggagtcgagggacccaagggagaccctggcccccaaggcccaaggggacctgttggcccccctggacaagatggcatccctggacagcctggacttcctggtcctcctggtccccccggcccccccggaccccttggtcttggaggaaactttgcttcccagatgtcctatggctatgatgagaaatcagctggagtttccgtgcctggccccatgggtccttctggtcctcgtggtctccctggcccccctggtgcacctggtcctcaaggtttccaaggcccccctggtgaacctggcgagcctggcggttcaggtccaatgggtcccccaggtccccctggccctcctggcaagaacggagatgatggggaagctggtaagcctggccgccctggtgagcgtggacctcctggacctcagggtgctcgtggattgcctggaacagctggcctccccggaatgaagggacacagaggtttcagtggtttggatggtgccaaaggagatactggtcctgctggtcctaagggagagcctggcagtcctggtgaaaatggaactcccggccagatgggtccccgaggtctgcctggtgagagaggtcgccctggaccccctggcactgctggtgctcgtggtaacgatggtgctgtcggtgcagctgggccccccggtcccaccggccctactggccctcctggcttccctggtgcagctggtgctaagggtgaagctggtccccagggagcccgaggctctgaaggtccccagggtgtgcgtggtgagcccggaccccctggccctgctggtgctgctggtcctgctggaaaccctggtgctgatggacaacctggtgctaaaggtgccaatggtgctcctggtattgctggtgctcctggcttccctggtgcccgaggcccctctggacctcagggccccagcggcgctcctggtcccaagggaaccagtggtgaacctggtgcccctggcaacaaaggagacactggtgccaaaggagaacccggccctgctggagttcaaggtccccctggccctgctggagaagaaggaaaacgaggagcccgtggtgagcctggacctagcggcctgcccggacctcctggcgagcgcggtggacctggtagccgtggtttccctggtgctgatggtgttgctggccccaagggtccttctggtgaacgtggttctcctggccctgctggtcccaaaggttctcctggtgaagctggtcgccctggtgaagctggtctccctggtgccaagggtctcactggcagtcctggcagccctggtcctgatggcaaaaccggcccccctggtcccgctggtcaagatggtcgccctggacccgcaggtcctcctggagcccgtggacaggctggtgtgatgggattccctggacctaagggtactgctggagaacctggaaaggctggagagcgaggtgtccccggaccccctggcgctgttggtcccgctggcaaagatggcgaagctggagctcaaggagcccccggccctgctggtcctgctggtgagagaggtgaacaaggtcccgctggctcccctggattccagggtcttcctggtcccgctggtcctcctggtgaagcaggcaagcctggtgaacagggtgttcctggagaccttggtgcccctggaccctctggcgcaagaggcgagagaggtttccctggtgaacgtggtgtacaaggtcccccaggtcctgctggtccccgaggaaacaatggtgcccccggcaacgatggtgccaagggtgatactggtgcccccggagctcctggtagccagggtgcccccggtcttcagggaatgcctggtgaacgtggtgcagctggtcttccaggtcctaagggtgacagaggtgatgctggtcccaaaggtgctgatggttctcctggcaaagatggcgtccgtggtctgactggtcccattggtcctcctggccctgctggtgcccctggtgacaagggtgaagctggtcccagtggtcctgctggccccaccggagcccgtggtgcccccggagaccgtggtgaggctggtccccctggtcctgctggcttcgctggcccccctggtgctgatggccaacctggtgcgaaaggtgaacctggtgatactggtgtgaaaggtgacgctggtcctcctggccctgctggtcccgctggaccccctggccccattggtaacgttggtgctcctggacccaaaggttctcgtggtgctgctggtccccctggtgctactggtttccctggtgctgctggtcgtgttggtccccctggtccctctggaaatgctggaccccctggccctcccggtcccgttggcaaagaagggggcaaaggtccccgtggtgagactggtcccgctggacgtcctggtgaagttggtcccccaggtccccctggccctgctggtgagaaaggatctcctggtgctgatggacctgctggctctcctggtacccctggacctcagggtattgctggacagcgtggtgtggtcggtcttcccggtcagagaggaaaaagaggcttccctggtcttcctggaccctctggtgaacccggcaaacaaggtccttctggagcaagtggtgaacgtggtccccctggccctatgggcccccctggattggctggcccccctggtgaatctggtcgtgagggatcccctggtgctgaaggctcccctggaagagatggtgctcctggtgccaagggtgaccgtggtgagactggccctgctggcccccctggtgctcctggtgctcctggtgctcccggccctgttggtcctgctggcaagaatggcgaccgtggtgagactggtcctgctggtcctgctggtcccattggccctgctggtgcccgtggtcctgctggaccccaaggcccccgtggtgacaagggtgagacaggcgaacaaggtgacagaggcataaagggtcatcgtggcttctctggtctccagggtcctcctggctctcctggctctcctggtgaacaaggcccctctggagcttctggtcctgcaggtccccggggtccccctggctctgctggttctcctggcaaagatggactcaacggtctccctggccccattggtccccctggtcctcgaggtcgcactggcgatagtggtcctgctggtccccccggacctcctggaccccctggccctcccggtcctcccagcggtggttatgacttcagcttcctgcctcagccacctcaagagaagtctcaagatggtggccgttactaccgggccgatgatgccaacgtggtccgtgaccgtgaccttgaggtggacactaccctcaagagcctgagccagcagattgagaacatccgcagccctgagggcagccgcaagaaccccgcccgcacatgccgtgacctcaagatgtgccactctgactggaagagcggagagtactggatcgaccctaaccaaggctgcaacctggatgccatcaaggtctactgcaacatggagacaggtcagacctgtgtgttccccactcagccctctgtgcctcagaagaactggtacatcagcccaaaccccaaggagaaaaagcatgtctggtttggagagagcatgaccgatggattccagttcgagtatggaagcgaaggttccgatcctgccgatgtcgctatccagctgaccttcctgcgcctgatgtccaccgaggcctcccagaacatcacctatcactgcaagaacagcgtagcctacatggaccaacagactggcaacctcaagaagtccctgctcctccagggctccaacgagatcgagctcaggggcgaaggcaacagtcgattcacctacagcacgcttgtggatggctgcacgagtcacaccggaacttggggcaagacagtcatcgaatacaaaaccaccaagacctcccgcctgcccatcatcgatgtggctcccttggacattggtgccccagaccaggaattcggaatggacattggccctgcctgcttcgtgtaaactccctccatcccaatctggttccctcccacccagcccactttcccccaaccctggaaacagaccaacaacccaaactcaatttccccaaaagccaaaaattgggagacaatttcacatggactttggaaaacatttttttcctttgcattcatctctcaaacttagtttttatctttgaccaactgaacgtgaccaaaaaccaaaagtgcattcaaccttaccaaaaagaaaaaaaaataagaataaataaataactttttaaaaaaggaagcttggtcctcttgcttgaagacctatgtgggtataagtccctttctgcccactgggcttatgataccccaaatgctgccttttctgttcctttctccaccccctcttggggcctctcctccattgctccccaaatttaagtctcccccaaagacacaggaaataatgcattgtctgcccagccagcaaaggcaatgctgaatcgtcccaccagcccctcaacccccagcttacttccctacccagcaccttcaaatcctgccgggacattgggttctcggactattgaaggagcctaaccatctggcatctccatggcctctgcaacaaatccccacacacactttgtttttgagggcctgtgctgggggagccacctgcccctcgcaggggtttggagccaggcagggtcacagcagactggaaacatcggccacacatgtgcaggctgggtgggagagactgttctgttccttgtgtaattgtgttgctgaaagactacctcgttcttgtctttgtgtgtcaccggggcaactgtgtgggggcggggatgggggcagggtggcatcgcgcccagtttggtatcaaaggtgctacatctctgtgaaggggtggggtgggaaggaatttctggtgctatagaatctgagatgctcccctacaccagcaaatgttccttttgttcaaagtatttttttattctttttttttttttaatggatagggacttgtgtgaattttcttttcctgacggtgctatttaacaagggaggagagagtgccaactccagcctgctctctctctacccccctcttcactcttccagctcctgggcctatctgatgatctctctctcttctgaaaccctcccctcttgctgctgctccctaccctcagcttctctctctctctgtcctgcatcagggtttcagagcaccattttccaaagcacaaagcagtttttatccctggggtgggaggaagcaagagactctgtacctattttgtatgtgtataataatttgagatgtttttaattattttgattgctggcataaagcagggggaaatgatccagtccacag
